United States Patent 8,153,369 (ASSESSMENT OF RISK FOR COLORECTAL CANCER) - sequence listing, part 4

SEQ ID NO: 1777 - DNA, 2096947 bp, Homo sapiens
  CSMD1 gene - 2782790 - 4839736 of chr8; NCBI Entrez Gene ID: 64478; Build 35; sequence includes 20,000 bases upstream of initiation codon and 20,000 bases downstream of termination codon of the gene
aataggtatttgaccttcgagaaacctgcattaaatcaatgttacattagggtcttaatgccattagctcaatagccacatgcctaggtattttcttctttcacaaggtcggaaatcagtaaataaaaaagagataattagcagtgaatacttgctactcacattttgtgtacactacattatctcttcccattgaagacttgccactatagcctatcacgcaaaaaatgtaaggaacatcctgtacattgcgcagccacggggccttcctcgtgacctcacatatgtttccagggcagcaaattcatctggagatagcacacactttgatttatagttggtcaaagacagacttctgaattacacacactaaaaaggctaaaacacacgttatactttaagtcgtgaggtacgtgcgcagaacgtgcaggtttgcaggtttgttacatagatatagacatgccatggtggtttgctgcacctatctacccgtcacctacattaggtatttctgttttattttattttttatactttaagttctagggtacatgtgcacaacgtgcaggtttgttacatatgtatacatgtgccatgttggtgtgctgcacccattaactcgtcatttacattaggtatatctcctacattaggtatttctcctaatgttatccctcccctagcctcccaccccccgacaggccctgatgtgtgatgttttcctccctgtgtccatgtgttctcattgttcaactcccacttgtgagtgagaacatgtggtgaactgaggtacctggttcatctcattgggactggttggacagtgggtatttgtatttttagtgattacgcatttctacctctgaatctgaagcagtagttttatcagtcaaatgcctagtgactagaatatttacaaggaaggtagaggccagcaccagagtcaagaaatgcagtttccgcagcttctcactgcttctggctgtgttactaccagagctcctaggtgtctgtctgttctggtcatagtaacaaaataccacagactgggcagattatacaacgcacgcttattttctcatggttctggaggatggaagtccaggattagggtgtcttctctcttcgtggttcatagcccgctgtcttctctttgtgtcttcacaggactgagaaagagagagagagagagctttctggtgtgtcatcctacaaggacactgctcctgtggggtcagggccccacctccatgaccccattgaggtttaattgcttcctcagtggccttgcctccaaatacagccatgctggaggtcagggcttcaacatatgaattttgtgggaacacagacattgagtccgtaacatcatggctactcagctccatctccccaaggtgtttgttgtccaacgctaacataggagtcaattgatatccttgagctcaagtggcatgaccgggtggctgggcatccagtctcatgatagacaattgtattacaccaaaataacttttaacaccagcaaaacagtcatgaactagagatgaataaagataaaaataacccacacaatttgtaaaaataaagttcttcctctgaatcatctaggggaaagtaaaggagggaacgtttttgtgtgttctatgtgatggcatttatgggtccagggcctgacttagcaacaggctggaaacagaaaccttcaaccttcacccccatttatctcctgggttcttacccactttgctgggggaaagatcatgcctggccttgttttattaggtaaagaggtgacaaaaggggaacccacaaaacaacctcacaacctcccagaagggcctaccattttcacacagagtctgatcagattgctaaaagtattcaaaggtgtctttgtaaactgagacccctgcaaggtagaatagtgttgtctgcagctgtgtaaaacaatgtaagatatttctgctataaacatgacacatacctccgaaagatgttatattctgccaaatgatggactaaaaaaccacaaggcttataggaaagaggagttcagggccaaactctccttgaggctataaatggctaaccccataaccagagccctaattaaaaacagctgcctcccgatgtgtatggacccctctccactggctcggccaccacttttgacccactgtttttgctcctcagagtggcggagctttaagaacacttattctaatagaaacctgtttcatcaaaattaaaaatacaactcagggataaccttttcatcagttagtattttgacacaggagaaaagcaatatcttggttagattgacattttttatttgccctgtctacaccctccctttcccaaaatatgtgcccatgtggattacaatggaatcacagttggtggctgagtcttccattttgaaaatatatactttacgaaatactcagcccaatagatatacatactaaacaacctataaataaaagatcaataaatgaatggatgaaaaacacgatataaataagtgattttatgtggaatttttggcattaaatattgatttattcctgtaaaagaaaaaaacaggaactaaatccctattatagttaaccctcttgtcacataacactttgcacaaggatagctgaaaccaaaatatgatttcctgtaagtagcagaatgagagggtagaagagatttagggccatttaaagcaatcttctaacaaagtgtgaatcttaaacatgaaaatatcatactaatgctcaaaagtaacctttaagctactgaggtcttgagaaaaagtaaagcttgaattcacaaggtgggtattgaactttggggttttcttgtccaagtatataggaagattgataggactggatttggtttcctcaatagatattggaaatccaatcactctgtgagaaagagttaaaggcttgagataataagtaatgacgatttctctggagaaaccaatcccaaatttcagttcaaaattgaaggggacattgcaaagaataaaatagtcctatcatttatatattttttttcttttttgccaacctgtgatttttttcatttattatttcaaatccttacacatctcaataactagttttccgtggacgtctttctccccatttatctttccttccaaattactacagacatacagggattttccatgagcagaatagctgggtaagagagaatgtaaactctggaattaggatgatgagggtcaaagcctggtggtaccatcatctcctggtcctaagaccttcatcttttcaaccattaattttctcagtttacatatgaggttcgagtaatgcaactctctatataaggaaaatgagaatatttatctgatggggttattgtgaggactcaaagagacaacctccgtagctagttcctggtgcctagtaagtactcaacaaatgattggcattactaatattactgccgctccctaaaataattttcttaataagcatcaagaaaagaatcactcttcatattaaacttaaggaacagtgtaatttaaataactgtagttacgttacttgtgaatgcaaagaaagaaatcaaacttctccctaggaaaggtgcgtagagccaatttcatgtttaccctggtggaataacctaggagacagatacccggaagccatgtcattatgaatgaaaaaaagaaacaaacaaacaaacagaaaaaccactggtgcttgatgtcaatgtccaaatctccactgctagaggataaatcaagagaagtgaaaatgaaaatgtagaagcctcttccaatttccagtgcattattcataagtattacaaaatcgctggacacgttagaaaaacttgttacatttatcatctctttgattttcataatgtcctgtggaatatggattattatactaacttgacaaaagagaaaacttaggttcctgagagggtgataagcaaattaacagccaggattacacagtccctgcatctcttctccagtcagctgcatttacctttcacttaggtgctgtctgcaggaatagcatcaaggacaaagtcccagaatgggcttatattcaagagtttgtttctagaaaacggaagttatcatttgaaaatttttatgaaaatacacacatgagggggaattccaggcgtttcagtgtagtctgtcgatttatttatttttcttctctttctgccatctctgctaaattttgcttttctctggaacatcctcctcagttgccctttatccgtctgtttcctttgttgcttttttttcagtctctttgttcttttttaatttttattctaagttccggtgtgcatgttcaggatgtgcaggtttgttacgcagataaaagtgtgccatgctggtttgctgcacgtatcaacccatcacccaggtattgagtccagcctacattagctatttaccctagtgctcttccttcccccacccaacccctgacaggccccagtgtgtgttgttcccctccctgtgtccatgtgttctcattgttcagctcccacttataagtaagaacgtgcggtgtttggtttcctgttcctgcgttagcttgctgaggataatggcttccagctccattcatgttcctgcaaagaacatgatcttgttcctttttatggctgcatagtattccatggtgtatatataccacattttctttatccagcctattgttgatgggcatttgggtttgcatgcctttgcaattgtgaatagtgctgcaatgaaatacgtgtgcaagtatctttttaatagaaaactttatatttctttgagtatatactcagtaatgggattgctgggtcaaatggatttcagtctttgaaactctgtattaattactgctctttctaatctgactactgattttcaactcttgaatgagaaaaaatagaaaaatctcagcaaagccattgaagttttaaagtaatcggtagaaatatagttgtgaataaacataaataaaaagcttgatggatacctttgagagtagagaagagatgacagagggtgaactcagtgaacttgataacagtgaagtcaccaaatctgaacaatagaagaaattagacagaaaaaaaaataaataaatgaacaaacagagcctcagggtcctgtgagataactaccaaaaatttaacgtttgtttcttctaagttccagaaggagaggaaagacagcagggatgagaggtctttgaagaattaatgggtaaaaactctccaaatttggcaaaaggtaaaaacctacagatcttagaaactgaggattttttttttttttttttttttttttttttttttttttttttgtgtggagtctctctctgtcacccaggatggagtgcaacggcgtgatttcggcctactgcaacctctgcctcccgggttcaagtgattctcctgcctcagacccccaagtagctgggattataggtgggcgctaccacaccaccacgtacggctaatttttgtatttttagtagggacggcctttcaccatgttggccagtctagtctcaaactcctgacatcaggtaatctgcctgccttggcctcccaaaatgttgggattataggcgtgagccaccgagcccggccgaagtgagggcacttcaaataggaaaaactaccccatccttcaaagaatgcaagaagacataacataattaaacttttgaaaagtaaagacatggagaaaatcttgaaggcagcaagagtaaggatgctgaggaaacaatgatgtgagtgacagcaggtttctcatctgaaactgcggaacgtaaaggggagtagcatgatgatcttccagtgttgaaagaaaattactgtctattgcaaacgcaatgcctggtgacagaaactgagtagaggaaaaataaaggaggaaataagaggggaatacaagcattttcatataagggaaaactaaaaaagatttatctctaatagacctacctgtattgactgactgaaggaagtcctccacacagaaagaaaccttacaaattagtgagactaaatggctttcgcaaattcgcaaaagtcctggaaagaagaaggaacagcagatggagctgagcaatgagtaaacacagtagaatgtccttctgaaaggcctcttgcatcttgtctaagttagagggagtgttggttctttgcagtagccatttcctgaagcactaaagggtgcgatgtgtttctcagtttcctgttttccagtagctccggaccaggtgaagttcagcaacctcgctccaaagccttgctcttcacatgttgcttcacttcactgactccttttccctttagtctgcaccgaggaaaggctctgttctaatggtagaaatggaagatggcaaagggaatagaaaacacaacttaatcacaaaataacagaacaaatgaggaatggattgcaaccagtgtgacagagccagtgagcatgggatggacatcaaagcccattatgggccgggcttggtggctcacgcctgtaatcccagcgatttgggaggcggaggcgggcggatcacctgaggtcatgagttcgagaccagcctggccaacatggggaaaacccgtctctactaaaaatacaaaaattagctgggtgtggaggtgcttgcctgtaatcccagttactcgggaggctgaggcacgataattgtttgaacccaagaggcggaggttgcagtgagctgagattgcaccattgcactccagcctaggtgacaagagtgaaactccacctgggaaaaaaaaaaaaagaaagcccattatgcattgtgaagagaaggagatttacatgaacacgcaccactgatggacgctatcctttatggcaggggcccccaacctcagggctatggaccagttcctgttaggaacatggctgcagagcaggaggtggacagcaggcaagcgagaaaagcttcatccatatttatgattgctcctcatcacttccattactgcttgagctctgcctcctgtaagatgggggcagcattagattctcgtagtagtatgaatcgtattgtgaactgtgcatgtgcgggatctaggttgcgtgctccttatgagaatctaatgcctgatgatctgttcctgtctcccatcgccctcagatgggagcatttaatgcaggaaaacaagctcagggttcccactgattccacatgatggtgagttgtataattatttcattatatattacaaggtaataataacagaaataaagtgcacaataaacgtaatgtgctggaatcatccccaaaccaccctctctcaaatctgtggaaaaattttcttccatgaaactggtccctggtgccgaaaaggctggggaccactgccttatgtggctttcagggtaaataggccgctgctcgttacggtcttttccaaagttgaggctcatgtttttcagtggaccttgtgcacttgtgatggggccctttctttgtgtcagccatgggataacgtcctcctgcacccatgcaaatgcacatctccccagtgaggcacgtgcacccactagaagggctgtcggggtctaaatggggtgtgtcgggataaccaaggccttctccatgccctcggtcaaactgaggaaagcttgtctcagattctcaggactatactttcacagcatgatattgcaggtggagaaacgtttcctaataaaagtgacggaaactcagtcactatgccatttaaagcgagactgtactaagctctagaattgtgatggaggaaattcttgtcctggcaggcaagagggattaaatcaacaaactataaaggaatgaaagaaaagcagtaattctctttgatgcttttttagcccgttcccttactaacagaggcgtgcattatttgcaaaagtcctggttgtttcatattttccaacttaagtgaagcattttataagaaaaagagacacacttcattaatagctttatttctaaactaagcaactctttatataaggatggtttaatatttcaggggctgtggattagttcatcagaaaaatgaactcacgtacctgcaaaaacttgcatgcaatttacatagtcattcaatcatctggaaacttgcacagaaccaggttaaaaatctctccttctatgatatttaaaattttgacttcatggctcatctggaaggttttcttacatgattaggattcttaatattttagaggaagttattttattatgattcttaccagagtttttctttcagttacttaggcattttctcaagaccactgtagctgtttgaaatctggcagatttcaaatctgcctttgagaagcactctcgttcagtggacagcaacatggtgttatggcctgtggctgtggatgggtcacccagtcatcaagccatatttctttgggtagaaatgatcatttccacaaccaaggttatcaggagaccagatgacgtcatgagcacacatgcaaaatttagttgtagagggacatgtaaatgttaattgttagtgtccatggtactggataaaaaagctagcccacaatgagaattcaaaaaatgtttcctgagtacatgtgggaaagtaactctactctaagtgggtttttgtctaattaaaaaaataacgatgtatatagcgttttgctgttaacaaacaggcttacatccactgtcttgttggctgtcatagtaatggtcatgttggctacattagttcacatctcaatgtctacaatgccaaaggaatgcgagcaacttggaaacgtctttgttaataagattggtccaaataactaacgcttgtacaaaccttcttcattttaacagtgtgttcccagagagtactcattgtactctcaaaatgacctgggtggtgaatcgaacatgtatcattggcacagttattaaaaagccaaaggaattaagaagaagtgagactaaatggctttcccaaattctcacagcttgtcagtggacatcagtgccttgaatcccgatctgcttcctcctggtttattttcttctcctccacctctccttgacaccagatccacccaacagcaggctgaagccaatgagtctcagatttagcttctttctcctttctccagagtctccactgcatgctcagacgaaatagtgcacccactctgctgctttgtccatgaagctgggatatttcatcaggctgatccttctctctttccctgaccttaatttctgaaaaaacaaacaaacaaacaaacaaacaaacaaacaaaaacaccctcagaagcacattctctgaatgtctgagaagctctctaaaagaccctgtcctactaataaagaaacagtcaggaatctgtaactcacagtcttgggaacacatggcacacccgtgtgtcatgcacgggtttgtgagtccctgtgtgtccacgtgtgtatgtgtgtacatgtatattttctccttgactctacccacaagaataaggtcctgctatctagttgtagatacttacacattcacatttgccacacctgaaaactgattcttaagttttgaagcaatttagtggggttggctcttaccagagccctgggctgaactgggggaacttttccaataaaggcgggggttcattttcttctcctctacccctctaaggtttgatggtcagtggtgtgatattgggtgcctgagttctgctggcatttgtggttcccacaaacaaacttcgggctacacttttggttccacaattcagtaagcatcaagctcctctctttcatcttctgaattagcttcacaaacacacaaaaaattaggagagaagggaaattgatcagtccagtgataaaatctgagtttcccaggtaaagcttccttaaaaatgactttagtagcaatttgctctgatcagttttccaaactatagtgtagcttgatacacaagaagttttgcttcttgctgttggggtgaggacagaagtacaagacaccaattccaattattatttccagttaagacctgccaaatgaagagcttggtgcacagttgtaaaaacacttgcagctttaggataacttggaatggttgaatttgagtgtatgtgatgttgggtgtctcattattcagactacctttaaagcttgcttccacaagagcaagcttaagcacaaccaaattttttctttctggtacatttttgtgtctggcactgcatttcccacaagcactgggggcttgggaggttgactgcatcctttcattatggtccaaatgctaacagtcccctagaaaaggccaggttccaaggaatcctgccatacatctgtgacctgtctgtcacaaaatccctctctgctcccaggaagcctccagtttctttaaggggatgtgtgtcattgatggtgggttaggccctgtgtctagattagtgctgacttattctcaaccttgactggcctagtaacctcagaaaatgctgcaaattcctggcactgcctggggtgtccagttgctggtgattttcaaggacctgtcccctaagcaaatgtctctctctattccctgattaccatgtttctgcaatcaccagaagaacagatcctgatccaggactgagtgtgatgatatagctcatggtgagcctgggcactgcgttctttaatacaaagatcccattcaaatgttccacagccttggaggcactgctcagccctctgcacttccatagtgcgaggcagtgtcctttagtcctcctgggcctgctccctggggaggagcaggataactgctctatttccagcacacagcaaccctggttaagaggatctatgtcagtatcgttttcctgtctcagaaattcagccacactcagcatttcctttggtctggcatctgcactgacaaccttgcagagatgaggaatgagaggtcccggcgtgttctgctccggctctcactgcctggtggtcccagttccgcagcccaacctgcttctgtgccctgtgaaagctcagattcacacaggctgctctctccagaatgagcaaaccctcaggacattcctccacttgagcagttcctgaggcttctgaacaaaatcctttccataccatcatgacataagcatcctctgtttaaaggaaagtcgagcttacatcacagagcacagattcataggtggaaaatgcctgcatccagcacacagggtccctccctgcctgtaaatgatggggtgcagttaatcccatttgacaaatgaggcagcatgcaacaaaagtaattttaattaattaagggattcagagagatgaaagagtggtccttcgttgtcatcttttcccatatagtttataagagcatgacaacatcttaccaacaaagattttgctgtgaggctgggaaaaacgcccagtgtgtcatggttaagagtaagggctgctaagatgggttgccttggcctacgctgcagggtggctgggatctcgtcaccgacaggccactgctactcccacatcccttaccgtgtcccattttacatttcaccctctcccctctgacacatccattttgggtaacccttcctacaatcaactggtacatgttcagtaaatacaaacttaaatctgtgaaacttgggtccacacttgaaaaagctttcttaagcagtcttcttaccaaatgcagatttgtttgagcattcttttggtagtcatccctccaaatgtgtgcacatgttttccccctgcacctagaatgctctttctccttgaagttcatgctgaactctcatctttccttcaggctcaccctaggtcttggcatatcaggaagtcttcagtggcatccctggaggcagcaggatgaaatgtacaaagcctggacctcagactttggtgttcatcctgtttctgataattacttatgacagccaggacacagcaattcatatttcctagcctaagtttctgcataagcacatacctgccacaagtttgttgttagtgcctgttctcttttcttcagtcatgcaagaaccttgcctgctacttctgtatcgtggcaataattgcagaactttacacttttcagatgttcggtgtgagctctgaagctgctgctactgttgatcacacagtggcggtcacctactccttcagctcccactgcagcattgctccatatttaaaagggataacccaagaattgacgacgttgcagtaactcaaaggatgataacttgctttttaaagaagcttttccaacaggagagattttgcatatactatttcaggaaatatttgaaaggatcttatttcaatcagtaagaaagaaaggacaatccttcaggggcaaaaaaaaaaaaaagaaatacctttaagctcagaggcaaagctaaaaagaatggagaggaagggtgctaaaacctcttgtgtcttttcaagttcaaattcagtattttccatatattgcttcaattaattctcacagcaatcctgtgagttagaaaatagattcccttttagggacgaggccaggaatcattgcacttgggtaaatgcacaaagccacccagctaggacatgcaggaactgagacacagactcagattagcgagaatctgcattttgtctacatgaagaatttctccatgtactggatgttgactagagaaagcaggcatcatcagaagaaacaggccctgcgaggtgaatctaatcctgaacttcagacactctctcgggcacatctctttgtctctcgctaccactttgcacagcgtactgtccctgagagcccttgttttctcaatgaaaggtcaaattacattacaggaattgaatatcacaagccaaacccgtacaagcgtcttccatgagtaaggtgctcttactctgcaaagcctccaagactcatagggcaaggcttgactagtagaatttcacacatactgatatttaaagggtatttggaaacttgaaatctataccatatcagcaatcacatgatttgcctaattttaaggtcatttagaaaagaagcgagcaaggaatgtggaaaataactcggaagtggaggaaaaaatggtggaaagaatcccaagaagtcttgtactcctgagaaggcctccgtctcttttgtttctcccaggctcaggcccttcattcatactgtccggagaattcctccactgagttacagttcacaaaatctttgaaaaggagaaggcaaggaggaagagtcagtacatcccacttctattcaccttctccacctgccatacaaccctcttttgagtgcatgaagcctgcagaagcaagagtcaatgtgttcagatgcaatgtctgtggcacccacaatgtccgggactgcgtgaaaagccattggtaacaacatgccagttttcaagtttgaagtatggctgtgctttatgtgtcttaaaactcagagaaggaaaacactttagctctacattttctcaatacaagggaattatcaagtgagaacacggcatcgctggcaagatgaaactgatgtagcacaatggatgatattaccatctccgcctcacacctgaatttaagacatttgtaggtagaatgagtagttttagttttgtgatcactgaacacttcactgtttttttataaagaaggtataaaaaattggaattgttcacgtttacagataaagacaaatgcagtgatttgtattctgaagttgctgccgagatggtgtgtgcacgtgtgtatgtgtgtgtgtgtgttattgtgattgtttcattgctattctggcaagctaaatgtttttattttaattttgcaatgtctttcctgtggagagctcaccaaacttatacagagcatgacaatatatggtattttgtaataaaaagaggaaaatggtaaagtagaggaaaataaggaaggtgagaatcacagaattttagatgtaggataagcattagcccaaacccttgttttacagataagaaaactaagtcacagaagtgacgtggtttttctgaaagtgagagaatagcatggagtctagtgcttctgaaatccagtcccactggataatggttaccagtgcaagtccccagaaaaagcccctcatcaccagtattcctgcttcagtattcctgcagctgctagagccagataagcacttatttgtgtttttgttttgtttgtttgtttgtttgaggcagagtctcgctctgtcgcccaggctggagtgcattggtgcaatcttggctcatcacaacgtctgccttctgggttcaagcgattctcctgcctcagcctcctgagtagctgggattacaggtgcgtgccaccatgcccagctaattttttgtcttttcttttcttttcttttcttttttttttttttttggatctttagtagaaatggggtttcaccacgttggccaggctggtctcgaactcctgacttcgtgatctgcccgcctcagcctcccaaagtgctgggattacaggcatgagccaccacgcccggccttatttgtgtttttatgacaatatttagcactggaggagcaatggggagtctcttgttccttcacggatctactgatgggcagtatcagaccacgctgatagctattcaaagcatctctgccctaggtgttctttcctgcaagaggagagcgtcattaatgaacattcagaatgtcacttcacctagttccggacgagcttttccagcttgctcgtgttccacaggacttgggaaacagccaggtgtgaggcagcctttcaagctgatcttaaaagtcatagtcagtaaaacccacggcttccccacatggaatcctgctggattcaccttgagacaatctgggagacgttgacggaatgtgtttcttttccctaccaacatccagtttgcagctcctaaaatatggatcagaacagatggaaatgccattctccatctgggtttcttctcttattctctccctttcagagactgactgaataaaaaaggaaaatcatatttttgagggtttactatatatcaggcattatgtctatattgtttggtttttccaacaagtctatgaggtagatctcattatctacatttcagaccagaaacttacacctagattaagtttcttcttcttttcttttttaggtctctagtctaggaaatggcagatacgggattcaaagcaggtcctatgggttccacgtcatcctccataccagtggttctcacagtggaatcctggatgcatcagggtcaatttgaaacttgttagacatgtatattcttagctaggcgtggttgctcatgcctgtaatcccagaactttctgaggctgacaccagaggatcaacgtgagcccaggagttctaaaccagcctgggcaacatagtgagaccttgtctctacaaaaaatacaaattaaaaattagaaaagaaatgtacgttattaagttgcatcccaaagcttatgctgtatcagatcctctggggtcgtggtcaggaatctgtattttcttttttgttttttttttttttttttttgagacagactctcgctctgtcgcctaggctggagtgcagtggcgcgatctcagctcactgcaagctctgccttcgggggttcatgccattctcctgcctcagcctcccgagtagctgggactactacaggggcctgcaaccacgcccggctaattttttgtatttttagtaaagacggggtttcaccatgttaaccaggatggtcttgatctcctgatctcgtgatcagcccatctcagcctcccaaagttctgggactacaggcgtgagccaccgcgcctggccaggaatctgtattttcacaagccttccaggtcatcgtgacatacgctgacgcctgcagtgacccttcattcggctacctaactgtgcaaggagagaatttgcagtgttgtcattcctcccagtggatcattcatagtgtgggttgtcccttgacagctcaatttgtcacgtgtatgtgtatggtatacatgtgaaaggtgttaatttatcttataaaaatgggaagatgatgaacatttacttatcaatccagtcaatgaggatagttaaataaatctaaatttacctaaataaatagctgcaaacgttcacagtttttgtttgtttttttaatggcttaggaaatggtctgtgctggagaatgctccatgtgtacgtgaaaggggtgtgcattctgctgctattgagtggcgtcctctatagatgtgtctctctgttctttcaacacaccacagtgggggcatagccccatgtgtgtgtgtcggaaccttggagtccgggtatgcttttcagtcagcaagggataggaggggttggcttttaaatactgatgtggccaaaggtttgagtatcgcgtgcattgtggccctcagcaagacgtgacccctttacgagtcccctggtttctcaaagccatcatgtccttatcactggaaggaggactgataaagacaagtatggtatcaatgaagttatgcataaagtgcctttgtaaacaaaacgtgattgttttgacttctgcttttattccttaagctctctcacacttttgctcacccaaggtagacactgcgctgctggaaacatggattgtgtggctcgaatactgacccctctgtcaaggaaacaagtttccccaattctttagttgccatcagtttttttttatatgtgacattaaacaaaccaaataatgtcacatttagccatcatgacaacacaccaaattttctaagattttcgcacatgtgccgcttttctagctaattagcattctcatctgggcatgttttaaaattttctaattttatctcaactatcatgttcatattttctgccccctcctcagataattccatttaaaatacactctccctcttcagtggctgcacttttcagatgtttatgttgtcatctctccaaccttgtcttaaattagttgctacctgaatttaggtatgtcattatcccttccagaacgtcagcacctctttgcctttaatcatcgcactgctcaactctctgatcggtcccgagtgccaagggtatttctagtgttgcttagccaggtcctgaggctgtggagagtgtgaggcccaggatggggaatggagtcagtatacaagtagagaagtatgatgttccaggcagcacaggccctggcagagaagtggccacagagcttcctggtgtgacgtccctgggcccccacactcactctaaccacgtgtggttaatactgccctaagtaacatgtactggacttctgatatagattaaggctttcgcaatcatttacacatcaaagtgtgtatgtatgtgtcgggggagcttgcagtgttctaataggctcaagctggaccgcaaggagggcacaagagtgttctggaggagattcaaaacgcaggcagggaaccgcagaggaggtcagagaagtaaaacagagggaccactgatctctctgcaaacgccaaacaagaaatattggacgctagatggcagcagagccccatgttttccttccaaattaagccagccttgagatcttgggcgaaaaattcactgtataaacacacaaatacaaccatatcagaaaaccagcttattttatttgtcagccgtttcatacccttctcataatcatgatcaataaacaatttggtacgaatcattgtaactctctaatatacgatcgggccaaagaaaataccccacataaataacagcaaaaaaaatgagtggttattggttatctggaccattatttctcaaggctttgtatcagatagattctttgctctctggggaaaggaggtggcatgggacgtttttcaacagaacacaggaaaagggaagttcagcccggagcctgtcacaattatgtggaaaggtgttccatctctcaggtgacactcaccgtcgttcctgattgggatcctaatcaagtgaaaatcatctatgagtcctagcctaggatggttagatgttggaaacgttttttaatggcagaaatccttcttggtgacacgagccattaggaatggcagtgtagagacagggcaccgtttctcaagaagaagtcagctcttaagctcctgaaaagagatccgtttttccggatgaggcgcttgaaatgaactattggagcacttaatgggtcttggaaagcatttttgttcactcgctgactcacagatactatctgaggtctgatttaaaatcccagagggggcgaccctctgctccacaggcccggttcagcctgaagaatagaactcaggggttctatgggaattcccccgtgactgaggcattctgtcttccgagtgtccctccagggatacatgaggcaagacgggactctgcgctgaggaaaatccaagtcatgttcaggactgcaactccaagagcacgcattctctccctccccacccaccccatatttaaatctcatatatctgcgaggagaaaagggttgtggaggtggccccaattgtggccacctgcaccttaggctgcagggagactaagaaagtcaggcttcggtgtttccatgccaaggttgcagtccttcctggatccattatgcctttctagggtagactaggtcacagaggcaggagcaatctaagaaaattgaaggagggatataaaactttatcaaactgtcaacccatttaatctcaaagactgacagaggaagtgcaggtgggatgaagcggtgggctgtccctcccaccacaggcattcggtgctgtggggataccgcaggtagatggttgtatactctaatggttccaggcctggaggctaattctctcttactagggtatgggatttccacgttctgtcctctgaaagggctaaacctttttggtcaaggatgtcgaatcctttaaatgtccttctatggaaaccagccctcactcgtggtgtttctattaactgaccaccttctcctaaaatgtctctccttacacgttccccaggaactgcaggaatgcctcctctatttggggagctgggtgaaatccagtttactgtatcaagtactgctattctaaagcactgttctctctctgcgggcttcatccttttgcagaatcagggagaacctgtctcttctcttttaaggtcccttcccaacccacagaattttatatatagtttcatcagaagctgtgccaacatgccggctctcacaaccagaccataatattaattctagagacttcctcatgtcacgttttatctgaagctgaagtttgggcatggctaaatctaacacaatccaaagtcaggaaatgtgtaaatttgtgtaactccttgcaaatagtccatcttgcaaaacattatacatatcatcatatatatatatatataaatgtataaatatattcctcccttggagttgaagcttgtgccctttccacctgcatttctgatctaagttaggtagggggctgctctctggtcagcaaggaagggagatcaaaggatggaggcgggactctgcccctgcagaaaccctccagtttgctggagttgccggattacattgttcctccccggtgtgcggcgtgagcttcccccacccgagcgcccaacaagtctcctttctccagcctgcgcgctgctgcgctgaggccgaatgaagcgcagcacggtgcgggcagcccgaggccccgaggctgggctctgtctgtctgggactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtaagacggacttgctcctggccggggaggcggtagagccctcggaggccccgtgtgcggacgcgagtgtgcgttttggggaccgcagggtacggagtggccgcctctgcccggcgctgctccatcgccgaagctcggggaacgcgatgcacgggagggagcttccatcgcgctctccccagccctcctgggcccccgccccaccccgccattccttccccctctcttgggctcacaggagagatctctttttctcggcagtacagggtgtcaaggagaaaggaacccaatacgagttgggctggaactgtgctccgccggggcggtgttgcctcctccgagacgtggactccacgggtcggggtggctgaggggcagttcccaggactttctccccggacccgacgcgcctgggaaagcgtcccgggtgaagccggcctggaaagttcgggctctctacgggggttttggtaccaataggcaaaggtctccgccggcccggcctcctcgcacccatacaccccattcctcctctcctccttccctctccaacgtcctcagccggcgaggagtagctgcctctagaaggtcgcccccgctttcctctcccccggacttcgctccttgcaagttgtaaggtgttggcaaggtgcgtgaaacaggctaggagttctggaccggcttccaagtcagatacattcactgtgggcgcacgggtatcctccttctacgctggtcaggggaaggagtttctctgggtggctcctgggcttggggctctgtgagcttggttttctccctgaatgagttggggaatgttttcttctaagtagcctacaggctgcgacctcaaggctggcaatagcttgtgtacttgtttattctccgggaaagaacataagctcccttttgagacagggcgagaaagagggagagagacagagagagagagaatactgattggttttcacattggaaatacctgcccctgtcctcatttttagcctccttagatgctttctttatcagtcagcacttccatagatgttcccgggagtatctgtatctacaaagggtttttctttcgtttcatttttaaaggttggagtccaatcttacgattttttttcaatggtcacttgcttttttccctacataatatttccccgtcctctctagattcttccatcttcttttccacccatttccttttcctccagtggtccagatggaagagtgattggcagggcgaaggaggactgtatctggttcattaggaaactccagatctgcctggagagcgggggagagacgtgccgcctgggcttcccctccctgcacttgcctccacggggcgtccagggctccgtgaaagctgaccgctcagcaccagctcctcctcaccggcatccaccctcacaagggggtgtctgcgggaatgcgccccgagatctcggggatcgcaaacagtgggtcttagtcacccaagctcgtggtcgctcgggactggggagcttcttgcagacgccgaccctctgcccacccgcccggctcagtccggatgccttggccggtgcctctgacattgccggctgcggaggcagcgcctgctgagcagggcccgactggcagcggcctctggtcagcactggactggctgggaattggaaggcgaggcagctaaagtctagggaaaagagggttgtgccctgtgaggtgtgctggggcgtgtgtgtcgcagcggggtgagggcaggagcccaagggacaggacctggctttttccagccgagcccctgcgtggagaggaaacacctgccacgcaactccgcaaaacttcccgccctttcccctgcactccaagcctaactgggcccggggcttcctcctttccaggcaggcaactcagcctctgagctcactctcggttccctcgagttccgcacgctccggctgccttcccccgcaattagcagaggttgctgcgtggagaccgcggcggccctagctcggctgcttaataatccgcacacgtgtgtgccgggcggattccgcccccacgcgggtgggctgcagcgctaggatgaggctgaggcggaggcgggagggagggtgtggagggccaggtagtgggcgggggctgctctggatgattctggggcgaacagggcaggggttgcaaagtcctgggcgcctcgggccctgcggggcagccccgtggaagagagctcctcttgcgcgctgcaggtcccagaacctggctgtagaagccgagaagtggagcccagggtcccaggcccctggcgtgcatggagctggagaggtgctgtgcgcaagtgtgtgcgcgcggagggggtccaggacgctcggacgtagctctcactgcgctattgtctggcccacgaggcagtgggtccgtggagctccttcattaaccccacagggaccagggaccgtgtctcctccacgcctgcggggtcaagtgcgagctcctgtaccggcctgggaaggggctgcaggcaggaagggggctggtgacgccagcgccggagtcgccgtttgtgcgctctggccattggggcggcgtcgcgttccccttgcctagcaaagcccgggtgaccaaggtcgggcctccccccgggggcgtcggcgctgggccccggggctcggcagcgcgctccagggcccaccggaggcgcttgcaagcagcagggctttcccggggaggagcgctccggcaggagggcgcccggccactgccgtgggcagctgcgccgcgcgcgcccgggtggcggctcccgctgtggcgaaggcaggcgcagagtttttgatgcgtggggcataattcgtgacctgtttgcggagtcgtgaggctggaggcggtcgcagttgaggtcactggaacccgttactgtgggtacttgagtatcagcttcagctgatggtgctgtactcttcaataaagcgttggggatatcgaaaattcactggcgatttcctttttcttctggattattaatggcattgtaaaggttgaatcccaagtgtgcctttctctttaaatgcctattttcagggaccaggggaaaaggagtaaggctgtaagcattttcatctggtaaacaggaatattaattctgtgtatgctggctcgtatctgcccctttacccggggctgatctactggctgtttggaagaagtttccttctcagttgtttcttgcatatgtgcagccatgagaatgcaggtatttgcagacaattacttacccagaaagcgtcctaaaggagagcacacacaacactactacgccagagcagcctcattttgagaagcccgaaagagaaaggtggaacattcgttaaagtaagtaattcaaacatttcctgacccacccagcagagatgtgagcacgcactgctgagtttccagagaaaccctgtaactccaccgcgagagaggtgcgccctcccatacctgcatggttttagatgagttaccttattaaagactcatcccaccaagaagtatgctaagacctttaatttgcaggtcagactcctttatggcagagccgcacccaatacccttcctcctgatgaagccaggacactcctgtgaagaagatactttcgcaggaaacccctaatccccatccagcaataaaaaagtgggccggatgctgtggctcatgcctgtaatctcagcactttgggaggctgaggtgggtggatcatcaaaggtcaggagaccagcttgaccaacatagtgaaaccccatctctacaaaaaaaatacgaaattagctgggcgtggtggcgcatgcctgtaatcccagctattcaggaggctgaggcaggagaatctcttgaacccgggaggtggaggttgcagtaggctgagatcgtgccattgcactccagcctgggcaacaaaagctaagctccatctcaaaaaaaaaaatgtgaaccccttaaaatgaagttaatatctctgtattgctgagcagatcatgtttttttcctgttgcattatcaggatattattactaattactatgacttcaaatcagaactgttcagcggaaagcttttcagtgcttctggagcactcatgtagttagtcgcaaaagggagtctttcttcggaagtgacaggttttgtaaacttgaatggtagggcaatgaggtctcatcaaacaagtccagagaagcaaatggcaagtagtgcagggtggtagaattcccccatgtctcaagcatctcactggcagaggcctcgggaagagagagaatggctatttttatattggctttcagctggccaatcatgcttggtaagacgactgccacaaccacagtgctgaagcttctacaggcgaaagcagctcctcccgggggcaatgcttccttactctccagtttattgtgtcaagcaaacaccaacccagctttaaaaatgtcaagaaaatggttctgcttcctttaagaaacagataaacaaagctcggtggctggttcgtgcttataagcagacgatacagcaaacccagtgaagacgtttctaagctgtcaaaatgcaaatggcatattaaatactctctattgcgctgaattttaaatctgcctctggtaatttttctgctgagctcatagtgaaaataagccattacaagttgcatacatgcaatttaagctaccttttccctttggccttttgtatgtcttctggttgagctcacttcgctctgtaagataactaagaagttgcatgcgtagttgcacatagtaaaggtcaagtatgtcttcttttttaatttaagttttatttgatcaactaacaaatcagaggaagatacttgtgtaaaggcggagatcttccacagtctacagtatttgtgtctttgggttgtatggaaatattaccagcctgttgtctcctaggataggaaagtaggaacttggactaagagaccagcagtggtaaacaagtccaaccaatctgacgctgtggcacagccaccacagcaaccaggggcagatttttttttttctttttttactgtagacctggcatggatatgcaacctgagccaaagaaatagaaatagatgtttcggctctactgaaatgaattaatcctcaaggaactcaacctttttaccttgccttcaattacatgatcattgtgcttagcaaactagttgtccattccagaacaactgattggtataaaaatcaaataattgcacttaggtattcatgcctaaatgcaaggaagtaagtcagtcttttccataaggactttaaaatgaccttaagtgacctttgattaaccagtatgtctattttggatggactttagtccttgatactgaggttggtaagtaacggaattaaaattccctttacaggaaaaagaatagaaggacattgtataattgagccagctgaaattgactgattatagggagctttatggaaataatgcacaccttgttttttccctccagcagatcaacctctttggatgcagagtgtgaaacagttctcttttctgagctcagttgcaattttctttaaaccatttgtatcaacctgtactttatgggagaggaaaatgccatcagtgctttagggaagttgcagaatgtttatttatcttcaaatatctttgttctatgaagatgagagattttgtcatccattaggcaccctgtctcatccaccaactctaaatgtgttgtaaacattccaccaaggaataacatttcaacaaattaacttcagttagagtcagtgtcactttgacctacggtggcaacatttatccccatctaaaatttctttggggaatgaaaagaaaaaagatcatgcaggcatatttttttgttaaaaataacttacgtattttattttactgatacattttgcaatttactggttgaaatcctgaactagttttagcttggtaaaagttataaaagggaaaggaatatttcagtgttgtcattccacccaaatatccttggatactttgatacttgcatcttaatgctcataatttgatacttgatgcttataattttaatgtaagtttgcctcatcctttgtaaagcggagagtaatgcatataatgctatgttttaaaagctatcattataatagacatgagatcaagaacataaacatgaaggagtcaaattgttggtgtctcttcccagtttttttcactgtattagtcaggattctctagagggacagaacaaataggataaatgtatatataaaggggagtttattaagtagtactgactcacaggagcacaaagtgaattcccacaataggctgtcagcaagctgtggagcaaggaagtcaacagtgcagtcttcagcctgtggcctaaagtccaagacaccccggaaaaccactggtgtaagtccaagagtccaataggtgaacaccttagagtccgattttcgaggacaagaagcatccagcacaggagaaagatgaagacctgaagactcagcatgtgggctttcttttagccaagatgacagttgatgagctggtgcccacccacattgagggagggtctgcccctcccagtccgttgactcaaatgttaatcttttttggcaacatcctcatagacacacccaggaaccgtaattttcatcctccaatccaatcatgttgacactcaatattttatattatataaaatatcagtcagattccagtgctttttattttttactttttggcgtgatatattttggggagcttcaacctcaatgaaattcaagaaaaactaatatgatgtggatatgatagagataactacaactttttgtctgaattattcagataattataaaccatgaaccccgatggaattaaagcaactttgcaaggcactgagcgttttcctaaagtgttgcagcaaccctctgctttctgtactgaacacgcctgtcaccgttatcattatagctgtcaaagtcagggtgggcatgacacacagtttttgaacactctatgtaaactttgtgtgcctaagaattacttgtttcaattttgattcaatgcaaattccatggcttcttttccaaatgattctgaataagtggattttggatggaggtagaaatctatttattttctacccacgcccatcccaggtaattctgatacagagaatacacgtaatctcacttagggaatgccacattgggtgctaggtagtaaaatatggcttctaactttgagatagtaaaaatgcaatggatatatctgtatatgtgtaatacctgatgtatactatatgcatttatctgtatataaacattatctatgtattatatattttaaatatagataggtagagtctatcaatctgtcatctctctaccttcctttcaataaaagtgatcaaaatctaataacgttttcactaatctttcacagaccatttagctcacactgatttcatgaagaatatactatactatgaaattgtgcaattaattcagaagatttcttctttatcatcagtgcctctattatcggtatccatcattcaatgctgtctaatcttcttttttttaatagttttacaacaaaacagagattcaagctccttgtccataatgtttatattatggggagacttcaggggataattatgctctttcatataaaaatactgttcgagtgaattattttttttcttttactgtttagtatactctgatatcattcgtgttatataagaaagggctaaatgttagattaaaatttgaattatttggagagtgatctctgatgaatgaaaaacctttgaaattaattataaattgcaggcagtcattttcaagatgactgaagaatgtctatgcctctatttagagaaactttttcctcctcttcttttttaacagaaagtgtcttcattgatctctaacaaatgagtaattttcttctacctgaagttgatattcctgtaaaggatgtcggggactctcatcattcccttttctataaaattacacctccttgatagttagtgacataactgtggttcctaaaatctttcctggcggcgctctgagtaaattttcacttcctgtgaaaatggtggattccactgaagttagagtctatcttcacttttatctcaaaggatgggccttatgaatgttcaaagtccatcaacaattttagtcaccacatttcaaactatcccttttatttggtaggaaagtagtgtactttgatgtataatacagctgggatagtcgagcattgcagagtatgatcggcacttcacaaaaagaagagagaccttggcaaactaagaagagtcacatttttacaagaaactaacaattcatcagacaatttctgcgcactccaaatgtcttgcaattcttgttgtgtctcttttcccctttcttcataaaatagaattcctgtggacaacataagaccaatccatctgtgagggtattttgtttttgtcttatggtttcagctatattcatgaggttgcagttcacttgttcaacatccatgctccattttacatggaaacaatacagattttgaatgtaatgccccatacttaaaaaatataaataatatcaagggaaattcaggtgagaatagtcatcttgttactgttaggtggaattagttttattgattaatgtgatctgggtagaactactgtgatttagggaagatatacacatttttagtctgatatgatccttaacaatgatgactggggataggaagagaattgggaagacttgactcttgaaaaggattatactcataattttgctcacctaaagaattatggcatgtgccaaacagaatcactcagttcagtataactgtaacgcatgggcccttcctattcacctacaccacatttttttttaaaaaaaacttttaagttccagggcagatgtgcaggatatgaagttttgttacataggtaaatgtgtgtcatggggggttgttgtaccgattatatcattaccaaggtagtaagcctagtatccattagttacttttcctaatcctctccctcctcccacccaccaccctctgacaggccccggtgtgtgttgttcccttctatgtgtccatgtgttctcatcattttgctcccacttataagtgagaacagtggtatttgattttctgttcctagattagtttgataaggataatggcctccagctccacccacgtccctgcaaaggacatgatcttgttcttttttatggctgcatggtattccatggctacatcacatttttaacaaagaggatgaatctctgagtgctttctaggagtttccattttgactttgccagtggtcttccggatgcatatgtgccactgctctgcatgctagcacatatatcacatggctcactagcatcttagatctccacccaggggtgtgttttttactattccagttagaacaggtcagcccaaggacactaagtatgggtttctgttctggcaagaatctgggggtttttccttctgctgttcatcctccttgctgcaggatcttctacccacatagaagtggttgtgctttgtgcccagtcaagtggtttgttctctccatctatctggcaagttcattcccctttacaaaaggctatgactaccctaatctatgtcaaataatggaggaggaagggaacaggaacaacatcatgaactgaagatgaggatgttgaggagaagcagccggagaacagacaagaaaactttgtgtttttcattagctcagtgagggccagttgaaacgtcaagcaggtaaatggtcctataaacactgatgctcagggccacccttctcagacattgattcattgctctttaaagctgaaggtcggatcggaagcgtacactactgtcatgggactagtccctgaaatatgcagatttatatgcaacttatgttaggccttgctcctttctactctcatgcagccaaggggtcatatgtttgtttgaacatcatctacttattggaagctagaacattagacatttttaaacattttcccttcaagtcctgtgatggttactcttgctgttctggagtttttctaatgacctccaggatgtaataccaacaggacactgagtgtggaaagaaaagcagtttttgatttactggccatgtatcttgttttcttaagtactgtacatgcttttctctgtagggtacagcatctctctcccaaactgactttcaaagtcctccataatcagtcttttcaaatctgcccttgtgacttccaattcagccaggccaggtacaccctaactataccttcagttttctcgccattgaggagttttctattccacctcatcgaccataactttgagctttgtttccatgtatctcaagcccacccatctttgagtccacttctagttctatcatatgttgatcacccaatctctccttgatctaatttttttgtcagttactatgtttaaaaattattagtcatgatgtaggaaactgtaggtttagggtcctttaaaaaatgttgttcttccccgtctctaccaaaaatacgaaaaaaaaaattagctgggtgtggtggctggcacccgtaatccaagctacatgggaggttgaggcaggagaatcgcttgaaccctagagacagaggttgcagtcagtcgagattgcaccactgccttccagcctgggcgacaggagtgaaattccatttcaaaaaacaaaaagtgttattcttgcttgctgatttttcattcatttgtttacattgtttggacttcataaatcttaaagtcctggagaactgaagggcactcttgcaagtatccaagcatcattctggtttcttacacattcactgtttctttaataaataaataaatgttctcagtctatgtaatatacttgattccagccattatttttagtgagttcaaattaatttgtcatcaacattttgtgaaaacactcgttgaagagttgacctagggaaggtgttggtaaagatttcttccagtcactgtgcctgcttattgactcatgtactgagactagaacttgtcaacataattagctttgaaaccctatattcaagatattattttgccatgcttatttgattcaattgtgtttctgtttcttgactgtttttctttgtatactgagtaagttatctgagatgtttgcatttttttcttctggtgacaataatttaatattagagcttgttcagcagatatgccagccttcaattgtcattttgatcttcatgactattttatctctccgctttttaattttaaagaattacattagaggattatggaacaaagaagagctaatcagtctctttcttttacaactgcagttacaaaattacctttcctgcattctttgctggcaacaagagacacggaaggggcatgtcgtcagggtgttgaaaagctgaggcgtctacggaactgaaagtataaaaagtatagccaagccgaactttggggtatgatctatatctcctagcaaatgtgtttttctttcagtttttatgatggatggacaatgataggtcttttaaaaagagtccatataaaaatactgtaaagtgttatatgacaagttgaagtgactatcatttcttcttaccttttatattttaagaatagaacctatgagaaagaaagaagtacctaagttaaagatgtggtgtcatttactgtagcttcaaaatcagaagaagagatttgagccactttttaatgcctttaatgacaatacccgttctttgtctccaaatgagggagagagacagaaagccaacagtatttgtagcaagataattttatagcattctctgttacccaggtttatcctctccgcaggaccagatgccaccaggaacaactcaagagctagaaaacagagctacatagaaggacagattgggggagcaatctcccatttgaatactttttgcattagctaactactgtgttgtaacattattattgcaaacgcaacagcttcaaacagcacacatgcattacctgatagtttccgtgggtcaggggtctgtgcatggcttggcagcttagctgggtctctgcttaaggtctcacaaagcagccatcaagtgttggctgggacttcattgccacctgaggctcagctggggtagaatccacttctaagatagttgggcagctggcagaattcagttccttgcagttgtaggaatgaggcattaagttttttgctggcttttggccagagtttaccatcagttcctgggggccacacacggttgtcacctgggacttcctagcatggctcaaaccaggttaggagtggggttgggggagagagagagggtgagagggagactccacagttgagtgctacaattccatatgtaatcacataatcctgtacacataatcacatgtagcctatcactgtcagtttgctgtgttggttgaaaggaagccacgggtcctgcccactctcaaggagaaaaggatccctagggcacggacatcagcaggtgggggtgccgcatggccccctaagagtctgttcaccacacactcttctagaaaagtaatataaaaagatcatctcacagtcagcaaagagcttagcaaccattaagtacaaataggtattttataggaagaacaaacataaataataaatgtaggaaaagattcccaagtgtataattgattgaaagcagtgcattaaacattgtcattttccccagtgcatttgtgaaactctaattgatgatatcaggttttggttgtgcacagagaggacactcccttatactcttgttggatatctagaaaaatgaggggaggggataattcggtcctatcagtcaaattctaaattatcagatgtttcaatctagagagttaatacatcctgctccagtaggggcttcttcactgtagccccctctctcatactgaaaagttggacagagcttaaatgtttaccatcctaaaatggccaaatagattgttgtatgacacactgtactgccttcatgaatgtgtttccatggtaaagcgttttcagttgaacgtttcaaataatatctatattttgatcccattttcaggtacagaaaaggcaggctacttgtacacacatgggaaatatctgcaaagatgcacgcatcatggtgttcacgcttgaatcttgtttggtttcttctaactatgtcaaccttctctaagtgaaataataattgttaaatttaaaaaaattgaagaaaaggacaagttgctcatactagtccatgttgctgggcaaagtacagatagataataagtttttttttttttcgagacagtctcactttgtcacccaggctggagtgcagtggtgcgatcttcgctcactgcagcctcaacttcctgggatcaagtgatcctcccgtgtcagcccccaagtagctgggactacagacccatgccaccacactcagctcacttggtgtagctttttgcagagacagggtcttgtcctgttgtccacgctggtcttggactcctgatctcaagtgatccaccaactttggcctcccaaagtgctaggattacaggcgtgagccaccatgcctggctagataagatttttgaattcaaagtgaccttccagttcacaaattcaagtctctcatttatttttgtccagaggatttcaatatctcacccaaaaggcagagctcagtctaaggaattctcctttcattttacagtgtttctcccaggaggcccacaggcctcttgaaagcctcctcgcctgacaaactccttccttcccacacacacaagaccagacctgcctctccatctcactccgcctctattgctccttgctggggctctaagtgcaactgaggcactgattctctcctaatgtaataggcacacagcccttgtggctacactctgggaagagcagcatgctaggaaagttctgggcttaaacttaagattacccaggcagctggataagcacagtatccaacctcgaagctcaggagatggctgagagctgtcactggtgacacagaactctctgtgtgtgcgtgttacagggttttattgctttgtataggaagtaacgataatttatttgaggtaaaaaatgcatggttgtgataacattgtgttaactatttaatttatttatttatttattttttgggatggagtctcactctgtcgcccaggctggagtgcagtgcactatcttggctcactgcaagctgcgcctcccaggttcacaccattctcctgcctcagcctccccagtagctgggagtactggcgcccaccttcacgcctggctaatttttttgtatttttagtagagatggggtttcaatgtgttagccaggatgatctagatctgctgacctagtgatccacccgcttcagcctcccaaagtgctgggattacaggcgtgagccaccacgcgtggccaactagttaatatgttttatatcaatatgatttgatctgtatatttgtcactacagaatatttaattctgaagaactaaacacattttcaccacaccaacatattttgtgaggactgctccaattagaacaattagacaattgcatttttagatttcttaatgatttaaatacattgaaggaaaaaatgatttcaaaaaagtgaaaactagctccttctttaggtagacagtgagtatcttatgatagaaataatttcccttagctttcacacactcaagtgttctaaaggtacctttgacggcatctgctatacggctaagtaagctcgagttccgtctctcctcctcatagtgtggccgtggaaaatgttaaacttcttgacacttggtttctttgtctttacaaagggaatgtcaactgtgctcaatatcataaggattacaagaagaaacacatgtaaaaagcatagaaccacgcatggctcttactaagcttaaataaatgtgagcagctattttattactgcaactaaaaaaaaattagactctcagttctatgagatgtgtcctcctagttcatcatttgaacttgtacatgaaatttagcttgaatacaattagagactcagtagagtcaggtagaaaagacgtgttttaacatcatttaacaccaggaaggcctggaaatttgaagtgactatgaaaagaacgatgagaggaaataataggaaattttgctcttcaaagtagatttttaaggtttgctactactttctccagagttattttttctaaagatcctaatgtctttgtgctgactgttcccaatagctctgtcgcccaggctggagtgcagtggcacaatctcagctcactgcaacctccgcctcctgggttcaagcgattctcctgcctcaacctcccgagtagctgggattacaggcacctgccaccatgcccagctaatttttgtatttttagtggagacggggtttcactgtgttggccaggctggtctcgaactactgacctcaagtaatccattccccttggcctcccaaagtgctgggattacaggaatgagccaccgtgtctggcccatatatttttctaactgcttacttttgttcaaaaaagcaccagaggctacttttgagtgttttaaatggtgtgaattcccagtgaagccatttgaaaaacatagttaatttatttacttggcaatatagtaaatctgttagctttttcaaggtgaggagcggttagtgaaatcaaagatgctgggtttattaacatctttaacataagtagggcccaattctttgacttaaacataccctccacccaaactaaacatagagggcttaataatgttaaggcagtcagtgtgatctggctttttccttctggctttagattccaagattagagtgtcctgactcaaattagagggacccttgagttgaaaaagctgctatacctccacctgcctgtcccccctttgaacacctgcaattatatcttaaaaggttgggtctctatctgtgagatcccaagttataatataaaaataaatcccaaattatgacatgaaaattagatgtttcttccagggccacgtgactgagacctttggaataggctacccagaactcacgtggccatgatcgagatacacacttctcaaagtcaggtatgctgagtctggctgtaaaagtgaatgtgtatctctctcacatcgattgtggccaagcacacatcaacagggaaacctcgtaaatacagcacctgtgcaggaccctcagcaacaaatagcttgtgaggtcttgggtattggacaccttcgaatgtgtgaatgaatgagttgattaagtattgatgatgggtcttcttccactgtgcttagtcaattcctatcaggccagccctatacttattcagtaaaagcgctgcagtatgccaaatgtctttcactttcaatgcattcatctctagcaggtgaacctgcctgcaacctaatttgtagcttagtgacttagttttcaaatgggacctccttaggaggcgctcacttaacaattatgtcaactagtgaggcatctgggtctgcacgtggggtaaggcagcagctgtgggtgggtgcgtgttcaggagagtgatttcagtgagatccacccaaaggcgggctggagccagccactgtgcgctgtgttccctctcaaagggagctctgtgaatttacgttttcatgccaatgtgaagaaagcccagaagagatgagaccttctttcccaatgtgcatgagtccgtggacatgcacccacccctcacacacaacagtctcctccagcctgaaatcctttcaacttgtgccatgaggagagctgctcagtgggcctggggtaagtgctgctgcgttttcaatcaaggttagaagggcgtataacccttcttgccttatttcaggaagaatgttaagttcagtcttacctttgcagaaagagttttgctctcacttggcttttattgaagggaatatgtattcaattaaatataaattaatataaacagaaaatagttaacaaggaaaagttcaaaacaaatgatcattactataggaacattttaaggccagctgttgatataaatgtgctccatcttgagagaaacgccaatataactgttgatactaaaagctgtataaaaatgagcattttgccaacacataatatggtcagttcgagtacacatgggagacatctgacaaattgctctattaggagagaaagacaacagcatctgccctcattccactgcttcagaacacacttgatgctctggaggatttttttttatgtttatagctgaccagcaatgtccctctatatttctttaagcacagttgccccaaagtggcacttacttaaatgaatatttaataaaaatatcagtgagaggaagtgatgtgtcatatacctaccatatcacatttgccatgaaagtgaagctcatttccagcaaggacatgctggacatggcatggggtatattaaaacaaataaaaatgctggagtaaaataccttctcatcctatttagggtggacgagggtcatagcaaatgagtttagcacacaatgtgcttgtctttaagctgtttataaattgttgcattattttggacatactaacaacaaatcagtcccaataattttgtaagtattgaatgctaggcatgccacagaggtaaggataaaaaacaacgtaatattataggagcattgtgaagtcagtttttgtattttttgtcaaaattgtatttaagaacaaactttctttatatttcattaaaatgccttcattaatttaatgtagtatgtaaatagataagataattatgttaagatgtattgaaagaaactgagagaaggaacagctgcaacttctgaggtagctactccatacatttgtaaataaattattacttgttacgcaggtgtattgcttaactcagaggtttggggtatggatactcttgtcacccaggcagtgagttagggtccaatagatggtttttcagcccttgtctctctgctccctctaggattctccagtgtctgttcttcccttatgtccatatttatccaatgtttatcccagtaataggtgagaacatgtgtcaaccaattattgacacttatgcttaagaaattattacctgcaagtaaacaaaagctccagtccaaaccagaaagggttgagtgtctgttgtacacctatttctttttcaagcagattttctcatagtaaataaaattatgttttatcacatatggccaatgtgagcaacataggaaatactatttaatcctctaattggtttatcttagagtgctgagtttcataagtagtatctgctgggtttttttctattattgcaaaaaaaatgcatacactattcatgactcctccacaactggtcatagtggttattatggaaacagttggccgtgtcttcattgtctcagcacatcagatgaaaccctgaagagctcacaatggtaatagccctttgcctacttcttgaattaccgttacctcacttcagagtaacacctgttttgttcggatgcaatacttgtacctggagcctacaggatggggtttctagtccaaactccactgtattccagttttgggaccttcctgggcttcacttccttcatctgaaaaataagtgatttggccttttgctttcagccctgacataacttgacttctgtttttagtggctatcagattgatgaatacatacttagaaggttaaagcaaagtagcccacattcaataaggccgcttacagccaggaagtaaaaggaatacttgctatgtgtgcaattattctttttcttttcttattgccaatgcttttaactcaataatctacagtctctcttcaaatgatatacagcagatattctctttaataagcgtaagttgaaattaattatccttggagactttttttctgatattttcataactttggaaagaaaagtcaccgtggtgaattaaaaacagtaggaccttggttccctcttaatttgctggaaccactaggtcacattgattatcttttttatggggacctagcccttcttggtagataaatgtttattgcagattttggggagaagcctctttccccagcctgctgtatgtgaatgccttctagtagagctctagaaaaaaacatccattttctcacagactaacatatataaaatttcgacttgaatctattgtcgaataattctttgtctctctctttaaaccccagtatatcaacataaaccatcatagtttttttgtgtgaaagttgatacagttgcaacatagttataatgcttaataacatacatcatcattgggagacagctcaatactgtattttatcatcccatattttcctgacaaagatttgaggctcaaaaaatcaccttctagtcagatattgtggattgcagagcaaagaccaaaggtgttatccttcgacatctgtcttactcttaggtctctgagtctaaccattatttgtacatgccttccaactgcatattcctgctattatatacagaattttaaaaatatatatgttgatgtttgttatacataaaacgtcgactccaatcttttttcaaagattgtatgcctgaactaactctcacgttattatgttaaaaataattttcatgtaatgatcattctccatcaacatgtagtgatttatatatagcctgtgtctgctaaaattctgtcaaaaatttaaatatatctcaactccaaatataaatattggagataatcaagggaaacttttaatattgcagctaagtgctaaccgacatgtgagacattgtgagactgtgctcttcaaaaataaaatcttgcgcctgtaatcccagcactttgggaggtggagacaggtggatcacatgaggtcaggagttcaagaccagcctggccaacatggtgaaatctcatctctattaaaaatacaaaaaaaaaaaaaattagctgggtgtggtggcatgtgcctgtaatctcagctactcgggaggctgaagcagaagaatcaagcccaagaggcggagattgcagtgagccaagatcgcaccactactctccagcctgggcaacagggtgagactctgtctaaaataaataagtaaataaaataatttccagagaggctaatctaaaactttcttgctttggatggcttgttattaagtgacttagctttgtaaaaattacttttcctttttattccaagaaacagacagactttggagaaaaatgttttcagccaggtgtgattgtgttggatttgtcacgttgatttgaaaggaataatgggttttcctatacctatactcagttcaggaacagctaagttattacataaaattctaagtttcccttttacatctttgggtgaataaaaaataaataaatgcacatcagcaagtctattatcacaacataagccttgaagagctctgcttatggtcaggataatgaatgggtattattcttcaatagagtgtacttaatggcatttggaagatttgtagagatacgaaattagagaacactttaagtcaattttatgtttgattgcagagatgtttttgagtctttactacattaagctgaagtaaactgtaggattctatagaattcaacaaagtttctatggtattattttttattttatcaaatgaaaatgtataatttaagagctagaaaatgttctaaaacccatactggggaaagtaatgcttcaggacaagcaaatagtatttataagtaaatttcacaaaaatcactgaaatgatttcaaatgtttgttcaatgaactctattgacttcgcctataagtcaaggcctgtgcagttatcatgtacctaaagcgaatgagataaagtccctgccctcaagcattttaaattccaagaaaatgctttctctcaataatatgatgagaggaaccaaaaaggcactaaaaagtaataaagtgttctgcaagatattggataattaatgcatatttcttggtgtgttttatatttaatacctatacagtagcatgagtttcctttgattgcccaagcactcttataattgaggttctatgcattattttaccttctttactacatcttttaaaatatataaaatataaaacgatgggatcaaatcacacagaaagtccaagtgatttttaatttttaaaatgacggctatgctggagagttaacttacagtattttcaagagtactctccacaaggtaggtcccagtacctatgttcatttagcaggtaattatgcagtttcacttcattccagatactgggcaatattcaggaaatagagcaattaacaagacaacacctagctcctaacttcatgatgcctgtcatttagatagctggaaaatgtgttggtaatcttcaaaactcaaacaatatttcttacctaaagcaaaagttttaaattcagggttgttgaaggaaagtcaacgatttgtctttgaatattgcttagtgtctgtattagttcattttcatactgctataaagaactgcctgaggtgagataatttagaaaggaaagatatttaattgactcacagttccccatggctgggaggcttcaggaaacttacaatcatggcaggtgaaggggaagtcaggcaccttcttcacaagatggcaggaaggagaatgaacacaggaagaactaccaaacacttataaaaccattaaatctcatgagaattcacttgctatcatgagaacagcatggggggaactgctcccatgattcaattacctgcacccggtctcccccttgacacttggggattatcgggagtaggggattacaattcaagatgaaatttttggtggtgacagagcaaaacaatatcagtgtcccattccatggttttgtgactcttacaggacacaaaaatttccatctttgtgtactaagcctgaagtctctgtttttataacttctacgtgtgtggtctcatttctacctacaggggcagcgtataacgatattactctttcttttatcagataggcttgaacatacttgaaaacgggtatggtatcgcttacctcttcaccttggctttttccctaaacttctttaagactttcttcaattgttggctgctgctttgaagataaatgttgatcactaacacctgtttattatccttcaaatgcatgatgtttgctcccaatgagtttattttatagaaaatgtcctaagtcatcacctactactatttctgagctaaaaggggattacagtccatttcttcctgaattaaaattaatgagacaaatcaacttatctttaaattctatatttctacttataataatgagaattgtattaattttagaggaattaggacataaaagttggtaatatttatatgaagaatgtaatcatagaagcaaattatatatatatatatatatttcagaatagttctcagtcatatgtgtgcaaggaagtaagaataagactatacattttgatgcatgcatttgcaattagaaatcatagtctttgaatgtgtggtaaacatagcctactgctaaatatatttctggcttaaaactcaagaaattatgtcagataaaaataaattcttcatcatttccttagttttataataattatggcaaataccacctgtctgccagctttcctttcagaaggttagaattatggaaacttgaattattgtagtgttagagaaaagagtttcttctaaacatttctttataagtattttctattttaccatagagttgttgagattattttttagtatcagagttaattcatgatttaagcatgaatgtgtagaaaatccatgttgagagcatttataagaggcttatataaaataatttttaaccactttatcaacttaaaggtactggatatcattaatatcattatgtcagcatatgctttgtttttgagttcaaaaactatagattatgagagttggaagggaccccagggttcagattgtttgaagtctgaatttggtatatgaaaaaaatgagatccaaaaaaagtcacagacatagttaagaccaaagttagttaagactaagtcaattcttaccctggaataactagatttttctctacaaaggaccataaataacactcttattattcttctgtaaacacactgatatcatatgttaacaaggaattgtaaggtaactccaacctttattacataaaaagcacttcgttactttcctttcttaataaaatactgaaaaaattttcaaaatctaccatactttgattttgatgactagagctagggtattacctggttttgagattctgtagttggaaaattaagacccttgtttggttttgtcaaaaaaagaaccacggcaggcacacttgctctttcagaatccacgtcctgagttaagatagcatttgtcaggctatttatttataactttttatttaagtgtttttatgatgtgtttaagtcacacaagcttcctatcattgtaaagagtagagatatttctggtaaaaaaaaatcaagatcattagtattgttcataccacctgttgtccaaagttaccataatatatcatatagtttaagaagaaacctctattccatgagaatggggttataatggagctcataaatgaccgatgtcattttggtcacataaacatctttcatgaattatgtttgtaaagttgatgaagataaaaataatgataacattagcataaaagctgataccatttttgaatctttttgttctgggtactttaatacacatccccttgccacatttacttattcccattttacagacaaatgatctatcacttacaggcagatcaaagagactcacaacttactcagctcccaaagtgaatgaatggcagagtaagaaacaagattcgagtctgaagtcaagttctccctctacactgtgtacctccaataataaagtaggatatgccttctaaatgtgtatagaatttttacatacaattactttatatattatttttatgtgaaactgaatacttttgtcatttctgtgtgctattattggacattcatttgcatttcaatttttaggtattgcagaaataattaatatacggaccatggaaggcatggtacgtatgtaaaatacacaaatgtttcatgtttgcatccagttttaaccgtagtatacttcaaactcaaactctaaactacctttattttgatacactcgtagtgacactatatcctacttgtttaagtaaagagagagaaaattcactactgcctgagaaaaacaattaaattaggtagtgttaaagttccacatagcagcctcattgtcttctcaggaaatcaaaacagtggagcatagtgcaatagtgtggaagagaaagccagccgcaggaatcttccctccaagtccccaaaatattgacacacctcgaaatcaatgggctcaaaatgaacaacatgttcaaaagcacagccctatgtgtatttgaataaaacctggctttttgagataaaaatagaactgagctgttgtgagataagagtaatattatttcctagacactggcctgtcttctacttgggtggaggaatggatggagacagaaagagagagagagaatgaatgaatatgaatagaaagattttctgtgaactggctcctatagatgatgcatgctaacttgccctactggatcttggcaagagcatccccatctcgttttatctggggtacaatgctttcctcattatataaggaaatgccaatattctgatatttaataatgtctatgtaaaatattttgccctagcaaattgaaaatgcctaagtaattcttatagaacattaacttactaagcattaggtttgttgtacaagtcactagcatagcagtgagcaggagaccaacacacacgcacacacgcaatcccatgataatggtataataaagtacaataaggtacatatccattcgtcctgcaaattataaaagcaaccaccaggtcagtgagctgtcaacactttacctacatggtggcattcaggatgaattctggagagtgaatagtggctttccagaagcgacagtatcttggtttcataaaaacctatgtgcaaaagcacaggggcttgaacattcatggagtgatggagagaatgacaaaatgtttgggctgagcattgcagtagttggtggcaacccgagagacagactgatgctttgtgtgtagcactaagcggtgtgcagtagatcctaatcttctggttgggaaatggcagaagagatgcaactgccagactttcctttttttatttttattatttttggtaaagaagagacatggtaaggtctgttaactaaaccagcaaacgtttatctgctgccactggtagaggttagtatttgaaagcagagatagctaagtcttttgaaccacactagctgttgatagaatatttgaaatcagcactgagggaggggagagaaactggtctgattatggagagtctcctttggttcaggcccggaaaaaaatatatataaaaaatattaattggtttttagtagtgcaggtggaaattagtttttgcattttgcattttcctatatcttaatctatgcagtagaggtctttgcagttaaatggctctatttcaatagtggttaccaggggcttgggtgttatttttttttaacagttacagattttctgttgggggtaaggaaaaagttttggacgtggatagtggtgatggtgacacaatcttgtgaatgttcttaatgtcactgaattgtacacttataactggtgaaattggcagactttgtagttagctctccataatataaattgaatttttaaaaatgaatcaaaaccctgattctaaaataccaaaaatctaattatctggaaaaaattatcctatttcagaagtatggcatttgtatttttgctgcttaataaaaatcacttctctttcatatttgaatggaaatccatcatgaaacaaattatatttctcagctaacctaagaactctaatttggctggcttggtttatttgtcagattcaattatataaaatgatgccaatttgaatctctgaccatgttatatctacctatcgtctttatttagaaaaaaaaatacatcattttcaatcattttggaaagtttcaaatgttctgcttccacacacggtatggtactgcaggagtcagcacatcctttgacttgtaaagttgtcatctcaactgttacaacttccttttaaactttgggtcagtcgaccctgtgaattctaacagttctctagctacgtaagtcacatgacacaagaagttcattattgatgaactaatgctatgtgaacgacacacacacagacttattaacatttgaggaagaaatgtatgcaagattcatgctcattagaaccagagaataaaatcatttaagaactgaacatagaaccgaagtataggtactgttacaactctgttaaaattaaaaatagttaataagaatttccaaatttgcatgggggaaaatattggcttaagatttagagataggtatggaatagtaatttcatgagagtgtgtacatagaacacctaatatattcactggtaatagacttaacatctcttaccttagtagtgcttactaatgtagttatttatcaatatgtattataggcaaaatggctttatcatggcagtgattattgtttttttcttcagaagacttggatatcttaaaactaattgttcagagaaggacaacttaaaatgcctgaaatggctacagacaagagaataattgataaaaactcaacctaagtattatccaactttgattttttacttactgctgtgctcttctttgcaaacaaatgagaagtaacagctcatagtgtttaaaattattttccgaatacaaggagtctcttcctttgaatgaaccctgatttttttttaagacaaatttatctgctcagacatttcaaatcagtgactaattgaattagccttcacccactggagaacactgcgatgtctggtcaatttcctgccatgcaataacatcagaagtacaaaatgacataaagtaaaatggcaatttgtaaaaagcaaacgttctctaaggaatttgcaacactggattgccaatgcttcagtcactttagttgatatttttaaccgtgcttgtgaataagggaaagatgatcttacataattaacttcagtaatttgaagggcatgttgacagcatgcaataaattctttggatttttacagttcgagtatatctgagttattttaaattaagacacatgttaaatccaattttatagtcctttttagttttttgccaaataaaaattattagaaggataatttgagtgaacttaattataaattttaacttgtatttcatcaccatccttctgtgtttgtacagggtgaacctacctaagacagtacctctcaatcacaaatgtatttagcatgtcagtgtgacacttgcacatcagtcactctcagatggacagtgacagttgggtttcagatgtctgcagccccttaagggcctcgcgatgtgtcccattgagatctggaagtgatggttgatattagcctaacaaggaaatgtgttccaaataccgggagatagtttggaactctttttttgttgttgttttttgtttgagatggagtttcactcttgttgcccaggctggagtgcaatggtgtgatcttggctcactgcaaccttcgtctcctgggttcaagtgatcctcctgcctcagcctcccaagtagctgggattacaggcatgtgccaccatacccagctaattttttttttttttttttttgtatatttagtagagacgggcttccactatgttagccaagctggtctggaactccttacctcaggtgatccacctgcctcggcctcccaaagtgcggggattacagaagtgagccatcacacccggcctggaactctttcaattcgagtattggtaaaagtcattgttcagctaaaaatacttgcatatcataaagtatccttcagtctgatttgcattctggatatgaggattaaggtgtaaacttgagttatgctcacacatgttgagagatcattctcaaattacatacacatcctgcttcaagttatctttctctacttatgtaaatatatatcttctttattttaacatgtttatcctccaatcaacatgaagatgcatttattttgttccagatgtctctggaagctcataaaattagattgaattctgggcagtttttccttcctaaataatcattagtatttcactctaaaaattaaaatgtgcattcaattttattatcttatttgaacatccagccaaccttatgggagactaagagcatgtactttcattccacttatacagctacaggaagtgaaattcagtaaacttcagggacaaacccagttctttcatttataaagaagtaaacagaaaactggttctgaaagatgttaaacagtttggccagggccacatgccccattgcgaagtgaagcagagactcagtcatccttctgatccttctgaatccacatgtcctgcattatcactgagacaactcatctatctataaaattgaaaaataaatcaggtgagtggtcaatcaaaatattcagatagggggaccttgtgtacacctgctttaaataaacaggtttgactttgattgaagtaatacatgtaaagcatttgcaactatgcctgatacacaataagtactcagtaagtattggctaattgttatcaatgggaacatttttaaaatctgaaatgtgttaaaatccttatatcagaggcccttcatgtgtgttttcttagatacataactcatgatatctgtatgctatctacaaatatttgcttgtatcttcagaacagatgtgcatattcacattacataagctatttgcctacaatagagattttgagaggctttgaaatatatttgattccttctttaaagtaaagcaacgtgcatattgtggaggacagtttttgaagtgaagaagtgacccaaagcaaaaggaatcaataggtagcaagtacatatgcaaagaaaggttaattcaccaagggctgatgtgctgaaaatcctgctccccaaactccgctccagaaccatcaaatacagctggagcaattacatcagacacgactggtattaaagtccatcgtgggtgcacaacaggtggacaacgacgataaaaagaacaatttcattcacaaaatgagtttttgtcaggttcaatgacaaagaagttttcattttttttcagtttggcttagtgaccataactgagtttctggaacctggagaatggagaatctctgagaagattttaaagagtgttagaaaaatgtatttttggaagatccacctgcttcagggtcattgattaactccagtccttcttgtccttcttggttctgtgctcctgctagtcatcctttttttttttccttccttccttcctttttttttttttttttttttttggagacagggtcttgctgtgttgtgatgggatcacgtttcactgcagcctcgacctcctgggatcaggtgattctcccacctcagcttcccaggtagctgggactacaggtgcatgccactagacccggcttattttttttcttgtactttttgtagaaatgggattttgccatgctgccctgctggtgttgaactttgggacttaagcaatttgcccccctttgcctcccaaactgctgggattacaggtgttagccaccatacctggctgcctgctactcattcattcattttgctctaaaatgtattaatgtatttcccttttctcttatctcctccttggtcctgaagtctttggaaagaatgtgaagataaaaatgaagatagtgccacttgagaaagtaaaaaaaataaaataaacccagaaagccagatatgtcttgccagattcacccagctatcaagataataagaaattttatatgttcttcacatgtgccatatgcttaacttttaggatttgacaatctatatgttatagagtatttggtatgaaatcagcttgtttttttaatactagtaagtgaggtgtataaaatatttgataggaattggaaagtggaggtatttctatgagcttaggttaggctagtatgattgggtgactactcccatggttagtgaaaatttcaataattctattgcttaccattttgacgttgccatgaaagtcatgttattttgttaagtgaccaagaaaacttgagttgagtgttaaaattgtatggtcaaagaagagcttttagacacctgtgtctacacagaggaatttcaacgcaaattcatactacacgtattatcttccacctgagatcatctaagttacaggaaataaatgatagcaataaaaataaatgtataaacacacaaagaccaataggaaagacacaaaagcaggtaagggaggtaaatctatttctaggaggtagaaagtgaatgaggggccaggcatggtgtctcacccctgtaatcccagcactttgggaggtcgaggtgggtggattgcttgaggtcaggagttcgagaccaagctggtcaacatggtgaaacctcgtctctactaaaaatacaaaaattagctgggcagggtggtgtgtgactgtaatcccagctactcagaaggctgaggcacatgattgcttgaaccccggaggtggaggttacagtgagtcaagattgcaccactgcactccagcctgcgtgacagagcaagactccatctcaaataaaataaataagtaaataaataaagtgaatgaagggattacagctgatttaccaaagcttacagagggcaattgactgcctgtaggagggccacccatgggaaataagcctatattcttgcggaggcctggagaggcataacacctgagctcctgggtgcagttccatgcaggagtaaggtgggaggctataaacagggcacctggttgaaaaatacgtatatagcgtcactagattcttcgatccttttcccagcgccaacccatgttctcctcccatctctcatcctgctttactaccagaaaagtggagatagatttattttttacaggaattaagtggcagtgcctctgcatttaggacaccaagcacaaaagaggtctaaaaatggagattaagtgaaattatttttactaaggagtgtaattttttgtcccctctctctgccatatcccaagaacattggcagctagactggcttctcctgccgttcttgcccatccatcaatcttgcacatcccttccacccacatggagcaagagactgcagtattcttcactgaataaattgaagtgatggcagagaaattagaaatactggcatctggggtgctttatcaaatacccatctgattatgccaaaatcctatagtaaactaatcagaaaatgtcctccatgcttcataagataaaaacagaatttaggctgggcacgatgggacatgcctggaatctcagagctttagatggcctaggtgggaagatcctttgagggcagtagttcaaggccagctttggcgacatagaaagaccctgtctctacacaaaattataaaattaagcagtcaagatggcttgcacctgtagtcctagctaattgggaggcaaagatgggaagctcttttgagaccaggagttccaagctgccataagctatgactgtgacactgtactccagtttgggtgacagagtgagtctctgtctccaacaaatatttgtttttttcttttttttttaaaaaaaaagcagaaatttacatttatattattgttttgtgtttcactggatagttgtaaaagcctccaatacaaaaaaaaaacaacaaaaaaatacatacttacatgcatgacaaaaacttaaagaaaatagatataatggagtaaatcaaaaaaaccttcccaaagttattactaatctcagagagataacagaaattttgtatccatgtacaggattttgacattcaaagacaagaaatatctgcagacaataacaaatgttataactgaataaaataatagattggaaaaaaaaggaaggaatttttgcacgtgttagaaaatgatgaaaatttaaagtgaaatcaagacgtggacaacaggaaataacaagaaagtagattagcagtatttgtcaaacaatacaaaaagagtctcagaaatggacagaaattgctagattgaaaatgttgtgaaactcagaaaaatatcagccaaataaaattacgttatcatttcagaaaaaaaacaataaaaattactctatacaacttgtagggtttttctggatgaaaatagagctcatacaaaagtttgagcgacaaaacggcacagaatttcacagtaaccatgagcactagataacaatggttaacgtcttcaaaattctaagaggaactaattttcaaactagccaaactaatggatacttattggtgctgaataaaatgtcattggagaatatgtttcactgtattgaggaaatcaactagaagaggacatttcaaggagtaaagagcctgtgagaaaagtgaagttgagacaaacattctactgaatgcctcaggggcaatcaggtcaggttgaaagaatgtttgaaaaggctctaagagtgaggtcttcggtggaataatgggatggatccatttttggatgcgtttgatgggataaaatattttgaggattttatataactgcagaagtgttagggaaaatatcactagttacacagaatactatgcattctaaaagtaagatgtatcaattacaggaaaacaaaaagttgttcaaggtaagaagttaatcatagtaaatgacttggattttatagtcctaatgaggtaaacacccgttgttaattttactccaaagtgtagtgactatttcgtagggtgagaagaggaagaatctttctgtaagagagtaaaatgctcatctatgatgttaggatgtcaatagataagatgggctaagtgcattgtttaaaaatgtgcagtgaaatcagaagtaacagccacatgcattgtaaatagttgtatttcaggagttgaggaatcttttaaaaataaacattttattattatataacttatgatgtaaatgaattcatttgataaaatagttttaccattttataacagatgatcatctgttcttgcttagatgtaagaaacttgtgtacccttataaaggaatttgcaattttatttttaggaaactaccggactaaaactagcaagaaataatttatgcatgtatgtatgtacgtatgaatggatgtacatatgtatggatatatggatgtatggatgcatgcacccatgactgtatgtatgcactggcattattctatctattgtgtatgaagattgcaggatactttttaacataagatgtacaagcgcttaactttacatctatcttgttccttgaagaatcataaacaaggaattcagcttagtttggtactttgtttatccccagcacatgccaggtgaaagtagttttcaacagtgggaaagaagagtgagatcggtagcttgccagctctctcaaatttacatcatcatagtgatatttcttattctcttctaagtaagatgtcagaacattaaacacacttgtctatatatcaggggcgttgcaaaattaaacaaatgttatgtatagtttatcttttccatttccttcaagatattatttgtatttcatcttctgagtgtcctagatcaagatttcctgagacagtgatctttagaaatattgaaaaagagttttgtgggtctagtacatttcagaagtaatgagcacattatatccctcctaaaaatgtattcattatttggcaatttttttagagtcccaatggtggtaaggcactgttctgagtaactgtgaaggctacatatgccttgttgaaattgcatcctagtgagcaaagagaaaccataagtcagtaacaaaatacattttcctatttttaaggagagtaagtgttattttaaaagtgtagagcagaaaatagggaagattgttgttgcaattctaatgagggagttcacctcattgagacactgatgttttcacagagactgttaaatggttaggtagttagctatgtggatatctgggaaaatcattctagaaataagcaacagtcagaacaaaggtcacgtacaggaagacttctggtgtaagttggtcattaggattttgacattccgtgaactgagagaactattggagggttttgatcaaagttagacaagctagataatacgctgagaagagattagaatagaaaggaacaaggctggaagccaggaagcctgctcaatgcctacagcagttagataggtatcgggtgataattatagtgccgtgaccagagtggtcaccatggagcagctggaagttgttggattctggatacgtttgaagatagaacaaacaggatatcctgagggcgttgcctctctgtgcatggttaggctacccaactagttgctttcctcacttgtgtccagtgcaactgagtgtggacaaaaatgagagcgcctggttggggattgccacctgacatgcggggaacaccaggtacatgttgaataagaaggtcccagaaattcctacaataaacatacctgttacatatctacttagcttttccaaaacatatgaccccagaatccattttaaaaatacataacaagcaccgcttcatggcagtaacgttgaacagaacgtacttggaagctgtgtcatagaaaccagtgatatgtgcaatttctttccaaattctcatataacctttaaaaatctatattaaaactaagcatagactaaactatttccctctagatgaaatcatcttccatttgatgacatatactatatagcatggcttgataatctcagttaaagcatacaattaagatttaagttttcacgtttcttgtttttaattttgtaattctcacaagacctaaggaagcaaaggcagctgcttatatttttttctaaaaatattctttcctctttgttgaaggaatgagaagtcaataaattacctgctttctttgactaaaggacatgcattttttagacacttgtcagaagcatgggatatattttcttcatgaaagccccgcttttttcacttctagtttgaaacagggggaaattactgatgacttatataaaagcttcatttatttattgagtcactaaatctaattatgtctattattcttaaaaactccatggtaactcacaaaaccagaaagactggttcacatagatcccatacttgaatagcttattattgtagcagaactcagaacactgccttgcttaagaagctgtcagaatttctattcatttcaagagcttataaattaactgtgggaatatttctggctgaactatggagtgcttgattctgtaagcctcaatatcttcaatatatattgcagttttctgttaatacttttaaccttcatctacctttattatagacttacattttgaagaaatgtcaattgcttaaaaattgttttaaaataggtgggtaaagatcaaccatgttcacctttaacttgattttgacaattggaaatatttgtaaaagttaaaaaaaaattgatgtgtcaaatatgtgcactttcattgaacctgtttttctaatctcatattgaatatattgactcttcatgaaaactataaaaatataatgtggaaacagagtatgttaaacacaaattgatcgaaacaacattttgtttgagggaaacatatgttctaaggacaggaaagacctcatagaatttgagacatcactttatggattatgaacactcaaatacatgaagctccctcttatcaaatgaatgctaaagatgctttctcctcaacgtcgtgacttgaaccatctgttgacatcacacaattatggaaaaaataacatcttactaaggagagaaaagcagaaggagtacttcaagtaaatgactaaaatacttctccttacagacaccagctttatcaatccacacttccatattgcaggggctggcagagtgactgcaggagctgagtattgtccaattgtactatccacctacttagctagtacacccctgtcctagtcagtttgtgtacacgttttaaattaagcatggtgagtccttatagagaaggggaatgggaaaagagacatggtaagaaacaaacaaaaaatcttactatagcaatgagtttttatatccttttgttaattttaactctagaatggtaaacatcatttatttcttcagtgcatttttttctttcatatgaggatctttcacaagattatttttaattgtctacaaagacactgatatcacaatgaatttctcatataagcacttcagaaaagttgataagaagtagttatttctactctgatatgtgtgtcttccctgaaatgatcaagagaacttaggcaaaaagaagaaagcgcctgttacatagggtttccgaccatagtgcccgtagatttgtgtttcattgctttttgaacataatttttcacaaactgccaaatgtgctcttctctgccaacgcatctttccttgtttaaaaaaatattaggggctttgccctttgtgtggggtgagaatttcaagcctgactccaggattcctgaaggcaactcagtaatattaggctcccaggcagaacagtttgctatagctttaggtctacaggtcagtgtttttcagttgtcacaaactgtttttacctaattgccagatttcatttgcttttattactcttcatgatttattatattttaaaattcatacttctagcatatctggcaacagtctcaaattaatgtgtttcctcttcctgaatttcttctcacatttctagctagacttaggattctgcttcagcagacacaagaatcaggagcatggttaggcttcccaaatagctgctttcctcccttgtgtccagtgcaattgaatgtggacaaaaatgagagcgcctggttggggattgccgcttggtgtggagggaacaccatgagttcacactgacttctgcaggaggtgcgtggaagcaatgcaacaggtgggaggagaaaatctaagtggaaggtgaacttgtcctgtttgtgaagtctccattccctggaatattttcctcttgtgttgacatagtctttgttggaacattaagttcatcatactgtaagtgagtgaatatcaacttgtttgttttctgaaagtttcatattttctccagtaattttctgcatttacatatatttataaaataaaaatatctgttatgatgatatacacatgtattttaaatatattatatgttatgatatacacatatattttataatatatttaaaatacgtgtgtatatgataacatatatttttatacacatatgcattttataatatatttaaaatatattttaatatgtatattaaatatatgcacatatgaattttataatatcttgaaaatgtatgtgtatatatacatcttatatcatcctatcttacggtaaacaagtatacatttatagtggatgttaattatttttattattcatatgctattaaatgttttaaaattatgagactatgcaaggtctgtcactttaaattaaaaaaaaatagcgagtaaggagggctgtaaaggtgttgaacaacttaaaaagaaaacaaatctccagtggccccaagtagaaaagaaacaactctagaaaaatgataactctgtcatccattatgagcgagaaagtaattagcagttcttagggtgataaccaaataactctcccctaagtggttttacgtcaccccaggataggagcaagtggtctttgagcacgtgactggagcagtctgagagtagttgtctagaatccttcagatactgaaaatcacagaacgcagcacagcgtttctcaaactcagccattcatctgaatcgcctggatggctttttaaatataattttttgcctctgaagtttaacaactactttctagaggggaaagatactgattggcagtgtttgccaatttctacgacctaaatattcccatgttggccaatttgaaggtactgttacgccaccacctaacatgcagtttggaagagagggcccgggcgtggtggctcacgcctgtaatcccagcactttaggaggccgaggtgggtggatcacctgaggtcaggagttcgagaccagcctggccaatatggggaaagcccgtctctattaaaaatacaaaaattagccgggtgtagtggtacatgcttgtaatctcagctactcgggaggctgaggcaggagagtctcttgaacccaggaggcggaggttgcagtgtgccgagatcatgccactgcactccagcctgggtgacagagtgagactctgtctcacaataaaaaaaaaaaagagaggtgagagttgcggtcgaagtagtgcatccaccaaacagacacagtaggcatcaataatctcaacacatgaaagacaccaatcataataaaaagtcataaaatgcatgggaagtactgttttctgtatttataaccttagtttttaaaatacaaattaattacaagtttatgcaactttattggtttttaaggatgactgtgtttcaaagatgcattgcaacatttctgaaaacttctgtgcacacgaatgggtagaagccaacgggaacagccccgtaggtctgcactcagagggtttctgatatagggaactggaggtgcagccaaagagtcccatttaaagccatttctgtgatgctgaagcgattgttccagagcctattttgagagccactgacatacagcaatggatgtcccgagaaaatcagctggctttctcgtctaagaaagaacattgaaaacccagaaaaattagacaggaacattctaaaagataaaagtgtcacagacaaacagaaacatgttttcactgatcatttcaatcaggtattttgaaacaaagtactctgaattcctgaagttatgagttagtatgtgtaatcttgtcaacaccaaaagcaaaagtaagagaaaatgagaatttttttcttaaagtcaagtatggaaaaccgtaattctgtgtaatagcagttattattaatattgctcttatcctccagtctctgcatatttccatggtgcttatgtagtttatgatagcttataaggaacattcacacacatgaattcagatgagtacacattgggtatttgcttttggtaggattttattttatagtatatccttcttttagaaagtataaaagttctaagtagataaaatgtgtttatcatttaaacatattttttaaaaaaataaaatctatagatgaattgaggtggaatgcatctattctgttgtgccacgtgatcaatttcagtcatcattcaaatcaataaatggtgtcagctatacaattgtgcacagcattgggagtgctaacctggaaacagcttcaatcagaaaacaatcacacacaaaaaatgtgtctttagagttacaaatggaaatatcacctttttaaataacaagcttcctttatttaaaacctgttatttgcacctctgttgtaacacttatcacaccatatcgtaattggtaattgtttaaaaataatttcttaaactctgagctccttgaggttagggaacacataatgtgttttctgtttgtttatttctaaatggcaaatagttggttcttatttgaacctactctttggcatttagaaataaaataatgtgtttaaattggcacaggtaggatacatggaagaaatgtttatgaatttggagaaagaaaagcactcaattctttttaacaggtgggtgggaagggtaacgtcttcattgctgctgtgtttctggtaatctcggtagtatttcttaactttactgtgcattaggtgcaccaggagagctttttaaacatcaaaacccttgatccctactcctgggtagtccaatctctaagcccagggttgagtcctgcaacctgcatttgaacagggatcccagataattcttcctgtggcagatagttcacaaaccacattttgggaaaattaccaaagacagagagaattagccttgcagaaagacaggtattgatctccatccaaatcttggaacaggcaaatttagcaacatgtaaaaatagcatattgataattcttttcttaatgtgaataacatttaattctgactgcttctgtgtatttctatgagtattgccaagtttttttctttactaaattttatgactagttgacaatcgtttctcaacagtgagaaacaaattgagataaaggtttataagggcacagttcaagttacataacttgccaccgtggacgatgttgggttcatccagaaatgctccttataaagcaattatttagtatttgaagtgatagtgttaatcttaatgattttatttgtccttcatattgattacatgtgttgatcgcatagtccttccataaatggtgattcaggatttagtatctgttaatgaaaagttacaacaagttcaattgtgaatagatattgtactttctaaaagactgatttagttaggctatttagaaatatatgttcaaaagataaggctggaaaattttcagcaaaactcattaggaaataaaagattttcctcctacaatgagtgctaccttatactttgagtgtatcttctaccttgagaattaaattcagttaatttgagttaataactgttacaattccatttgaatatatatttcttttaaggactataatgtttttttgtcttaacatctgctcacgtattaatggtcactctcatctcacatgtggaaaacctttagtataagtatgaatgcatggatgtggaataaaaacagccttctacttttgtatcaattactgccatgtcttgtagtatgtagcagtgaatcagttcagtatagatttcattcaaaaacatttgttaacaacatcacagtctacatccaacaagcttacctgcatatagtcagagttattaaaaacgctgattactgtgtagaagtattgtttcattaggatgtaagctataaattgaaattacaggaaatttcaaataaaaataaaggaatctctcaatatttgatatactcattttaatactcattttaatgtattccatgttttgcttctgatagatttttaaatccatatttgaacctctaccacaatcaccatatcaactatgctctaattgtgaattgtgaattaaatacaaaatcatagtgtggataattttaaagtgaaaatttaaaaatcatattaaagtattgaaaaaatagaatttaagtaattcatgaaaaggtaaacttttatgtccttaaatattttgccttttcttttagacataggtaattgaaatccagtaagtatgactcactaatatagactcttccattttacaatttttaagtgtgaaactgtgtggacatttgaatcaacgcatacattattcagtttcacttattgggtttgttttcattcccaaaaagcgttggctaattaacttgattataatatttgttgcgttttattatctataatagtttatcttatagaaaaaaatccaaattaactccacggagcaaacatggctttatttacgttttgattacattacttttcctgtgtaggagaggtgtgtgtgataattttaagacattattttgtgcaagatatttagtgaaattaagactattcagatctatttgggatgcattaatatagcagcatatttgcttacaattacgtgtaaaatatattttgtgtatatatatgtatttctatattatatatataattaaaaccttttaagataaactatgtttagaagcttggctctgaaggagtcaccagtttcaggcctaggggaaaaaataatttttttttctaaatatataaataaaatgtcattaatattttatagctcattgtatatgcagggtggtccttcagtgtattaactttgttgatctttataagcagcttgtgcaaaggagaaggctcagaaatatctttcaccagagatattaaggaaaggtagggggtgtgggtggagaaagattgtgagtaacattattaatatagggagattcttctggtagaaccacagccaaggattcctcattttttactaaaagtaggaaatccagataaaacatttcacagtcccagaagtcattcacaggcattaaaaaaaccccgcaggtttttcttttttttttgcttcttttcttttttattttctcttttccttttttcttttcttttcttttctctttctcccctcccatccttcctctttccctttccctgttctgtttccttttccttccttccttccttctttccttccttccttccctctttctttctttttctttttttttaatagaaggtagtaaaggagtcacacctctgatcctgactggctagaataattagcaattaagagcagagatagctcaagtaatagaaatatggtttgtgaagtccgcagttcaaagactgagcgtgaacaatttcaggcagagactaaaagtcgttatcagcaatgacacaggaaagagacagtttctttgtggattaatgtggaccatatggaatgttgcaggctaccatgaaaccaagatttaaggcaaggagtgatgcagaaacaaggggacagtccaagaggagggtgtgtgtcagaaagatggacatttttttcacattgtctaaatctcattcttcatttattatttgtatttgttgaagctacttcttgggggttaaattatgtataggtcccttctctattaattttttttgtttgtttgtttttgtttttgtttttgttttttttaccacaagtctccaagttttgtaattggtcagttatttgtcaagaatggtactttaaacaagtacatttgtttgccaccctggtactttttcttaagccaaggtagggtacaccaagagtggttgagtggtgctcctaatggtcaccaagagtggttgagtggtgatgcttacggtcattgtctgacttagcgtgctgccacttataaataatgctatattgtttgaaagtgcgtggtattcaatgaccaactctttttattgccaatgtaatcaaagtaaactctgaattctttttccggaaatccttggccatttaaaacaatgacaaatattaccacaaaagtaactttgctttttccttaaatgtgtagtgttttacatagaaactaaatttataaaaagttagttgctttactaaaaacaacttacttttttatgaataaagtagtgtatgtttaatagatgtaggctgatttatttcttatcctattttgcaggtgttctgctttttcacaagttgagtcgtttatttaaaataaaagaatctaaaaacgcttgtttgtgggtaacattgtcctatgaattaaccctctacttatttaacttttgaaaatctgtcttttaaagacaactgcaaatgtcacttgagaaaatcatttacttactaatcagaattaaccataaagtaatgaaaatatgtgtgtggcataaatgactaattttgtatttttaattagataagcatcaaatacttttcagaagacattggtacaaagattatgatagcacaatcatatacaaaagtgtgctacatgggaacatagacatatattaaaatcttatcatatgaaacatttctatgttttataaatatttatagagaaatatttctaggtattatttctaggttcttccctgtgccattattcatcaaggtgttttgctttaatctcaatcaatagtcgtgaccaattagataaaaaacatttgcattaactgtttaaaatattcttgcaatgtagatagaatacacacacacacacacactcaagttggtgcaaaagtaattggagtttttgccaggcaattacttttgaactaaccttatatattctctctatatatatatcctgtccttcagatatgctcaatattgcttcgagtacatgtttaggaaatgccacagaaacttcatatcaatttttttgaaaagataaaattaatacatttttagaaaactgtaacccaaatgatcccattaaaattctcataataactaatgcagtatttctcagccttggcactattgccatgtggggtcagatgcttcttggttggggatgtggaagggcaattgactgggcatttcaggaactttggcagcatcactggataccagatgtgacatgcaacaactaagcacgtctggacattgcagcatatcccctgggaggcagaattgcccctggttgagaactactaaattagatgaggcagtggttgaatatttttctataaataatacagcatactcaaataattttccaggaaagtttcaccacatgttgaaggtatagatgactgcaattttacacaaacatttacaaataataaagtgaaatatcagttaatgaggccaaaataacttttttttaacaaaacagctacgcataccataggaaaaggacaatcccaggccactctcatttatgaagataggtgcaaaaattctaaaaaaattatagacaaaccaaatgcaatggtatttaagacaatattataacatgataaacttgagtttatcctaagaatacaaaggcagtttaacatcagaaaacctttaccatttaccacatttacagattaaagttacaaaaaaagttatcccaacagaagccaaaaaggcatttgttaaaatgttacactcatttaggataaagacatttagcaaacaaagaacagaaggaggcttccttaaagtgataaattatatcagccttgctatataaagtacatctaaaattatatctaccaaaaatccacaggaaacattatttttatgtaaaaacatggtcttttatctaaaatcggaatgaaaagattcacaccataaccttttctaaaaatccttatgctgcagctccattctaggggaataagggaatataaaaacacgttaagactttcagggttataaagaaagaaactaaactatcacttttcttaaatggtacagatgcctacatagaaaattcaaaagattatacacacaaattatttaaaaatatgagtttagcaacctagcaacatatttataatactatatttcagtgataattttataatgtaattgagaaggacaccattgaaaataagaatgaaacataaaggtactatgaataaattttctagcagatttacaaaaccagtattcacaagattatgaaactttaatgaaggtcattatgcaatctaaataaatgcagacatcaagattactggataagaaagaaatagaaagaacaaatcaggaatagatagatatgcccaatgaatgactggcaagtaactagtacagaatatataaacaattattctaagaaaaaaatgtgcaaatattttgaattgacacttcaaaaaaggaaaacaaaataacaactatacctaacattataaaaatattcaaccccattaatggtaaagacgataaaaaattaaaaccttgatactatttgatacctactaaactcgtatatattatgacctgtagcaatagcgagaggtaaaaataaattgatcattaggaaactttgtaccatgatgatagtagtataaattgatacgaccatttggaaaataattggcacttaaaaaaaaattaatgttcttgaaattctactactatggtatctacattcctacagaaaagtgaatgtgtaacacaagctgacatgtggaagaaagttcatacagcagatttttttatggatatcttaaaaaaagaaaacaataggaataaacgcacaaagcacccaagaattacccgaatgtcttacaggagaatggacgcacaccttgcaatatgttcacaaaatgatattttgtatagcagtgaggataaataaaacacagctatatgcaaaaacttgatgagttttagaaacatatttttgtttgaaaaaatgcaaattcaagtaggacactagttttataatgtatcaagcaagcaaactcagctacaaactttagacaaaatatatttatgatgaatttatttttcaatgccaagaatgatcaacccaaaatgtaagtggttatctgtcactggggggaggaagaagaatgccgtaagtttacatgtaggggaagaaaatcttcaaatttttcatacaagttaatttatattcagagaattatcatgccacctttctgaccacatgtgggattgatgttattaccacatggttctcattttctcattgttgatgatctggacagatgacaagtcaaatattgacatttcttacctatgtgagaaaaaaactggtaattcttagacataattaattattttagggaatttcccattaattagtgctgagaatttggttagttatgcattttaactgggagaagaactgacctttttccaaactaccaaatggtcttataggtttcctgagtttattatatcattgccaaggtaattttaaaaatttcactgtttgaagtcagacaacatttaaaaagtagataacagcagtgaatgtattctgttaacatatttttctgttttattttgttgtgaatttgtgttaaatataaatttatgcacagatggatacaagtagttatagatgactatgtaactacaaatggattatcctattacaaattctgtagcatttgcaacaatactactggtaaaagaaagttcttattttgctgattgtttagcatttggattacagacattgattactgactcctcaaaataatatatatgaagaaagtgaaatattaaaatacgtatgtacatatgctctgtctttctaaaagaaacatatattttctgattattaaatcatggctatgatttaaaatcttatgtcaaaataaatgtgtaattggaggcatgttttatttaaatagaatcacagtctaatttatttccctgtagtgaagccagtaacattggtgttataactgaacctactgatgctgaactgtacaccaactacacatattcaacctttggggagagtgagtgaataatacaattgttaccacattgcttcatttttaattcgggagtcagattctaaatatggcataaatttagtacctccttccttagacataagcctagaatttagtgttctattcacttatacagagtcagaatccttcataaggacatgcttcaggcctggttagaggcagctggggggatggctgtcatattgtacctggggagggtagtctccatagagggtcactgggcagaccagcctgtcactcaacacacggtccaaagccatcttcatggacaatgaccgatgacctagttccttcatcactaggtgggggcatttctcaatggtgactaaagcaccctcaaaaattgttttaaggtttcagttagtcatattaattgattgaggttagttttgggaaaaagctttcttcatctcacaagaccaaaagcatcagtctctgagaacgtaacaagacagggatttagatccataaattaagtatgttgagtcagaccaaaacaacacggagtatcaaagtttttaattgaaactgcttttgaagttatccctgtaacccgattggactcagagccacgtagagacagctgggtgtgcaagtggactttcgttgccagcggcaatgctgaaggaccacagcagacgggagaagtctgatgttcacaagagcccactggttcttattacaggtctctaccgtgtcttctggagcctctgatatgtcctactttcttgcacatagctcccagcggagtttgataacattctgttttcttcgagtgaatgctattattcaggagtttctgtgattgtctgccaaatcctgctagtttcagtggcaaggcgtgaccttggactctccaaaactgggttctgctgcctacttaacctcatccgtcaccattctccagtattcatcatcttctccaggtggcatcatctcctccttgtaccctccaaaagctgtaattagttttctctttgtctttgttaatgccaagttctcttgaaaaaagtctcctttcccaaaactaattcaaatattcaaactttatcaccttgaatacatcacttagaatttcttatccagagatttactgaggctattcttgtctttattttttaaagcatttttactgagtaccacttttttttttttcatgtccttcctctttttattttgtttttttaaaactcttgggctcaagtaatccgcccacctcagcttcccaaaatgctgggatgtatttttttaaattgcggtaaaaatatacataatatgaaatttactatctgaactatttttcggcaggcagttcagaagtgttatgtatcttcacatggctgtgcaatcaaccacatcatccatctccaggacttatttattttgcaaaactaaaactctgttcccattcaacagtaactccccatgttcccttccacagcctctggcaatcaccattctactttctatctctaaggatttcactgctctacaaacctcatgtatttgggatcattcagtatttctcttgttgtgggtggctaattacgctgattatattgtgcttgaggtccatctgtgttgtagcctatgtcaggattttcttcctttttaggataaataattttcgtgtgaagagaccaccttttgcttatccattcatctgccaagggacacgggttggttccacctctcgtctgttttgaatagctctgatacacacgtggacatgcaaatatctctgtgagaccctgatgtcgactgttttgagtatatcctcagaagtggattcctctattatatggcagttttatttttaattttcagaagaatcaccatactgtttttcacagtagccaccacgcaccattttgcattcccaccaagagtgcagcgggtttgccatccctttacatcctcgccaacagttgctattttgtttttattgatttatttcttttcgacagtagtcatctgcgtgggtgtgaggtgatgatatttgcattcctctaatgatcaataatatcgaacatctcttcatatgcttgttggccagtccgcatacatttttgaattaatgtttcaatttatttcttgtgtatttattttgtctcttcaggtggactgtagactccttttagtaactgcctctgagtctgagtctctgatgtgttctttcagctttcccaagatctgtttggtgtctgggttagtcaaatgaggatttcaagaaagaatgaaaattatatctcaaaaagtatttcaagagaattcctacaaccatctgaatagtgtgttgagcatttttgctggcccttataatttaaacccaaactcactgataactagctttcttctcttggtctgctctgtaaactttgcattgatctccataatactcacagtatagaatcctcagagctctgttgaggtcgctctactttctatcatcttttggtctttaattattacatacactaggaatttccaaatctaagttcgtggattttttctctttcatgagacttccaagatattcagatgcctaaaactcagcagaatttagacttgaatctgcctttccttctactccaaacttcctcctgtctatcaaacatcttcctcacttctttccccagactttccagcttattttgattcccaagtcttttttactactcaaatacaaccgccagtatgtcttgtcatgtttctttcccttaatacattttctgtctttccataatcaatatccagctcggccctccatcaccgcaattctgcgtacctttaagcgttttgggctcttacacttatttatggctctatcttggcttcgatttgttctgaataatgatgctgtcaaatcttcgttcataagggattttttctaacatgcaattttcagggaaagtaacttaccaaagtcctttgcttatcacatcatgatggatatcttcaaatgtttttaggaatgacatgtggaacagatatgtgattcagtctgcaaagttctagataggataacttggacaacatagtataaatcatcacacccttttcatttgatatatgagatatattttttaattgtttaaaggtatttataaaggtaattggttacagagaggtgatgattttattttattttattttattttattttatttcattttatttttttgagacggtgtctcactctgtcccccaagctggagtgcagtggtgcgacctcagctcactgcaagctccgcctcccgggttcacgccattctcctgcctcagcctcccgagtaactgggactacaggcgtccaccaccacgcccggctaattttttgtatattttagtagagacgggttttcatagtgtcagccaggacgatcttgatctcctgacctcgtgatctgcccgcctgggccgcccaaagtgctgggattacaagcatgagccactgcacccggccatgattttcaaataaagtgcaaatgtgctttgaaaacggtatacataatgaagaccttactaactgattagaagtgaaattaatcctccactaattccttcaaattgtaaaatctatggagtcattgtcttcatctgttatgaacaattactttcatgtctcactatttcttgatttggtcttcctcaaagaaagccatactctcaacagagtcctgagagcgcctgactttctgggaagctgccttaagctatctcaatcctgaatgcacacccatcatctataacctaatccaaaccattgtttcaatgtttatatctttccaaaaagctttcatagaatgttttggatacaaataaaggtcccactatctgtgaattagttaacacctattatcacagcttcatttaagttgcagtttccaattccctagctacatcatctgtgtatgtcatttctccctgtctgtgttgatgaaggtcggtattggattctccactgattctgtgtctgccaaactgcctatcacagtgtgatatgcggtgactcacatgtgtatatttagtggatagatggtgaaaagtggcaagatccatattggaacattagttcttgatgacttagtcattagagtgaagtcacacttttaaatatgtgagaattactaatctgtacattatttaatagaggaaaatattttgaaaaaatgaatttaacaaatataagttaaaatattttttaaaatgtgaaaactgtctttgtcatgatggttggttgggcatgatgtagataactgtgaattcctccagtacaacatgataagagtaatctcagcaaagaaacatcaaactacaagggtaccgagaaagcaatgggttattctatctgtcagagttaggcaagaattcacagaggaattcttttgaatcatagttttatcaagatggaagagggaagtgatttcagaacagggaaaaaataagagtgaagcctggtttatatgtgtctgtgtgttggggggaaggaagcaaaagtggatgaaaataagtgacttgaaaaataaatagggagtatattatactttgattggaagagaatatttaggaattgtggaatgttacctgtaaaaataggaagtgaagagagattcttaaagtagaagagccagacaatcccatttacccagggtaattttgaagactgtaatgatttgattcaggttttaaatgacttttaaaaacaacacatactcactggaagaagcagataaaaactgttgtgtttgcaaatttagcatcatcaaattgctgatggggccagatgtggtggctcacacctgtaatcctagcactttggtaggctgaggtgggaggattgctttgagctcaggagttcaagaccatcctgggcaacatggggagaccctgtccctacaaaagaattgaaaatcagtcgggcataatggcacatgcctgtggtcccaactactcaggaggttgaggcgagagaattgcttgagctagagggatcgaggctgcagagagctgtgattgtggtactgtaccccagcctgggtgacagtgcaaggctctgtctcaaaaaaaataaaaattaaaaattaaaaaaaactgattgtttccatgaacaggataaaaatgaaaaaaattgacaaagactgcagaagaaacacaacaagttacatgtgtagataactgttgattctgaagatcaattcttgcttttttgaaattgtggcacacttgttgtacaacatggcttcctatataaacactgttggtacagaatgtcacaaatatcttagaccatcaaaagataatatttttattttgaatatcatattttagtactcaaaacatttattatgaagcgtgtgctttacaaaaacaaagtatattacatcaaaataactttttgaatcaaagaatgttactgtgtttgaaacaacaaaagagtgttacaatgttacaatgttttgttgttttgaaacaagaatgaatgttacaatatttttgttttttattttaatatttattgagtgatccaatttattgtaaaaccaattagtcaaaatcagaggcgaaagacaaactccaaaattcaatataattatgtttgagatggtttatctgtcagattacaaaaataataacagaaatgaaaagtgtagattgttcctctctcaaaattaatcgctctttcttgaactttaagaaaaaatacatttgaaaaatccatctagatctaagaactgttaaagaaatattgcccaaacacttctcctcttggagaataaagaaatggtgataaaattacctgaagaaaaaacaatttttaaccatgacctctaagccttacctgacacatggtacaagctgacacatggtacagagattatgatttaaaatttttttgccccctcattttctatgttgaagcattaccacctgtgctgctaccctggagatttgtgagcaaaacatgcatattttaattggttgatttgatcttgtaaggtattggtttgttttatgtgttaaagaacgtaagaacctctaatgcctaagtgagaatttgtcccagaaataaacagaatcaaaacactgacctgcctctctaaacttcacgaggctagttgatactgtgtggatgaattttcagtttgatttctgcaaagctaattcaagtgcctaggttagcaaacaaagtggggacacagaccatgcccttcccaactcttgtatatttataattaaagagaatcaaagtacatattttacacataattggaatttcttaactcatgtaatataactgtatatttccactcaatttgcatattttaaaaatgtgaaattacatgggcacgtcagaaaataattcagattgaagccatatcattttactctgcattttccactcaatggactgttaactgctcacactatttctgttcttgtccttctcaaatacgctttgactagggtggccaggatcttcttaaagaggaaataggtcagtcaatatcttgcttcccacactcccctgacccctccctgctctcacagggggagccaagacctcctcagcagcccccggtagttcacatgcaacttttctgcccggttctcctacctcagctcttgtcttctctgacgggagtgcaggcacatggatctttcagttttcccaatcttcccaataaccctactctgaagatttttcaagttttcccaatctttttttaaatttatattttaattgacaaatcaaaattgtatatatatttatggtacacaacctgatagaaataggtatacattgtggaattgctcagtggagcttattcacttccatgctacatcacatgtgaattcttttttgtgatgagaacacttaaaatcgactctattaacagttttcaagtaggcagtacactgcatactccacacgtactctctgtgctgtacaatagatcacttgaaattattccttgtcctctgattttaattctgtaacatttggccagtatctcccaattccttcccactcacccccagcccttgttaatggccgttctactctcggcttcattgagttcaactattttagattctacatgtaagcaagatcatgtgatatttgtctttctgcgcctggctcatttcatttaatgtgatgtctgtttcattcatattgtcacaaatgacaggactgtcttctttttaaaggctgaatagtactccattaggtatatagattacgtttctttatcgattcacctgttgagggtcactgaggttgtttccatagcttggctattaatgaatagtgctgctagagacatgagcttgcagataccgcctcgacatatggacttctcctttggatgcatacccagtaggattgctgcatcatatggttgttctatttttagttttttgaggaatctcgatataattttccatatttgctttactaatttacattcccaccaacagtgtacgtggattttcttttccccaagaagcaaaaatagacaaatgaatggcatcaaactaaaaagcttctgcacaacaaaagaaataataaaataaagaggcaacccgcagaggggggagaattatttgcaaactgtgcatctgatgcagggttaatgtacaacacgtagaaaacattcctatgactcaatagaaagaaaacaaataacctgatttaaacatggacaaaggactagaataacatttctccaaagaagacacacaaaagtttaacaagtatatgaaaagaggttcaacgtcagtaatcatcaggaaaatgcaaattaaaaccactgagtaacatcacgttacacctgtttcaataatgtttggcaccttttgccaaaaatatgaaatataaaaaagcattcccctgcacttcttgacccacaggccacacactttttaaccttcccattctcagatttcagatcgaatttatcatgagaagattatctgtttctttccaccccattatcatgaggcttgatcctggagttcaagcactgattacagctacgtgtttatgtaaatgtgcttgtataaatgtttatgcaagtatgcgttttcccgataagactgacaactgtgtgagggcagggaatatccctgtcatactcagcacagtgtctgggtagtcaccaggtgtctataccatcgatcagttttttgtcaaaccatttgtgaaaatgtttgtctttttactagagaacaagtgagtatgcatatgccacttgttgatgagaagtgggcatggagtcatatttgtaataactataggacagctgtattgggaagcattttggaatctttgaaatgttgcatttatgaactcattgcagttaaacttttcctgtcaaatttcccactctgcaaagtccaacaaatagagttttggaaattattgaaatccattttctagtgtaccagtcactccagagcttcactagtagctcaaagtcaacagttctgactatttctatatttccccaactctattatgttctgacatcagtgcaccaatgggtatttttaattattaacttaaaattctttgttgctactaaaagggataaaattttaatcatttggaaattaatactttttgatgtaatattattctaactatttttgagtacaaagattgcatgagggaggatgagtcacaaaggccaataaaactactgttgaaaacagattaaaattaataaaaacaaaatttagataagtaggtagctgacatttgggaaagaggaaaaacaagcaaggtgaaaattgtaatgttaatatatattttttagcttcgaatgtagatttcctgtgtgattaaaattctgacactttgtagttgtgtgtgtgtgtgtgtgtgtgcacgcgccactgtgtgagaaacttctctctagatcagatcacacttatcttactctgctcaggcgtaaagtcaagaaatcgttcatacccctaaagaaaccactgctctattttaaatgaggtgaaataattcatgtgcttttatttgatgcctccgtcagatactctgacactgccaaggtatttaggggacttttcctatctttgttctttgtcatgctgacagaaagaggaatttggtactgtaagttactagccattgttttttttgtcaccattctgtgctttgtaaatctcttttcatccaacacataagaaaataccttgccttagtattactcatcatagagaaaaacactatttttatatgaattcttcaacctgtcatatttcccagtaaagaatacactacatcaagtcccagcaggtgtgctttcactattttacaaaaacaaacagtggaaagtaacttgtagagtccatgaatatggtatcccccagtgaagataggactataccaccagatttgtccttatatttataaaaaataattttatttatttatttattttgagacagggcctggctctgttgctcaggctgtaatgcagtctcaggatcagagctcactgcagccttgagctcctgggcccaagcagtcctccaccttcagcctcctggatagctgggactacaggtgtgtgccacaatgcctggctaattatttttaattgttcatacagacagagtcctgttattttggccaggctggtctccaattcctgacctcaaggtatcctccagccttggcctgctaaggtgctagggttataggtatgagccaccagagccgacaacaaaaataacatttaaagaaaataaaacacaagagaaaataataatttgaacaaaaaacctagtcaaaataatagtgttttatgtattatttttatttagcagcaaagctgttataaaatccatttaatatattttatttgagtgtgttttagggacaacacatatagacaattccaatatgggttttatcaggtcctgcctattaacattgatgtttaatgaattacagtgaaatatttactagtcatagacaatggttaataatgtccataactagctcttgaattaaaatgcatccccaggtaatttagtgttgacaaatatatcaaataaagtgtttcacaggtaggtctacttaaaatgcttatgaatttctacctccaaacatttattcacgaaggtacaatccatccaatagaagtgtaattggaaaaggtgggcaaagttttaaagccttgaaataataagatgttctggacaaaaatccttctatttttttctatttatatcaatttgagtacatcttcaattttaaaaattatactgctgcccactctaaaaaccttaaccaggccgatttactatttcagttttttcctgtccctgtttgtttattcacaatcccatgcacacattttaaaattgaaatttcaaagataaaacatctgttatctgatgatataatatctgtgggcacattttaactaatctttattatatggaagcataataatttctgcctctcaacttaatgtgattttcaggatctagatgtagcaagaaagattatgtggaacaggacagaaaccatttttataactgtaattacctccactccttgcctatgatgatttcaatttccctttgctgtttctttgattaagtcttcactccctaatgcattgcactttgggttcctattattcctggctgtttttgctgattcttccatgaagctgctgaaaaggcagtgtaagtactaactgttctgagcggcagcgtggcatccaggagcatcctgctggggaggaagacagcccagaaattgcatgagttctgcttctcatgtgaagacgtttgaatctgcttttggtaaacagcaggccgagcactctctcaagttgcaattcctattcttgtattcctcgtctttctttctaatcacagaagaacttctcagattttattttcttctatcaaaatgcctgcacgccattcctcaatcctaacaagaactaaaaatatgtaaaactcgtttctttagttacaatggtgatatcatcgagagagagtgaatccacattttggagaatgagagcaaatgaaaataggcttatagactttttgctgaaaatattgaaattcagaaaaaagtgtataaccttatagagttgtattcattcattcgttcattcatgaaacacatggcttaatggattcacactgaaagacttagtttctgatttctggtaactgttagtcttctgcaagcattagaaatgaaccggtaacttcaacacagagtaatagggcttttgaggtgcatgtgcaggaggtaaggatacacacagggcgatgtctccacccagagggcgcaggggcatttcctaatgagacctctgcctgagctcagtcatggggaacaatttcaggttgaggatatctaactgaagaagaaaggtgtggggcaggaagaactctggatccagggaccacatatgggaaggcagagctgtgaaacagcatggcccatctggggaatttaaaatcctcacctgtgactgatacacatattgaaagtggtgagctataaggaatgaaggcagaatcctgatcatggggcctgttgtgatatgggattttaagtttatctgcataagtgtgtatatagaaatccttaagttctagatagatatgtatagatagatgatgaatatagacagatgattgatagatgatagatataggcaggtagatggatttaaatagatgattgatggatgattgctgattgatacattataggtagatgatagatacagatagacatgattgatgtagtatagttagatgattgattgattgatagatggatgataggtgattgatacatgataggtaggtttatagataatagatgattgatagatgatacctatagtataggtaggtagatagatatagatagtttatagatatatagatggatgaaaactgattgatagattatagattataagtagatggatcatagatgataggtcaataattgatcaataaatacatgatatatagataggtagataagtgaaaaataaaaaggtagacattatattgggcctgtgtcctttctttgtccatgttgcagtctccatctcgttcctagtagcaacttaagtcagctcaaagccccggaagctctctctgataagctcttcgtattttctataactcagtggagtgttgatgtgaatacaagctagaggtttgcaaaactacatgaaatgatagaatgccttcctgaattattattcttgatggcttcataaaacaatattttcatatctatacaaataattttgaatttaatacatagggctgcaaaacaaggttgatgttgatatggacaactgtatgttggatggtcccaaagcattctgtggggaaatatttatttttttctgccttgggggatgtctggataaaaatgttggaggagctttgcttctgagctcaggcagcctcttctgtttcttgttagcctggcctcttctcagagtcactgggccaggagttccttgtcaaaggtctctccctggtgctcacggctgccgcctcaaagttctcagttcatggagaccttctttgcattcatgctagaacacatttatctcatcatcaaaaccttcatttttttttaaaaaaaaagcataaacgtaagtaactgttgagtgagagtgactgtgtgggcaaagatgaatacattgtgattctgcctattatgaaatttaaaaatgtaacaaatgaaaaccctacttgaaatgatgcttctctgcctcaatgtatctttgtaaatatctatagtacaaatttttaatcaaaataaatgtatcgggctcacatctaggtccctttagaaggaagagaggaagaaagcaataaggatagttgtagttataagttagtatatcttttcaccaccatctgtgcattcatccattcttccatccatccatttatctttccttccttccttcctttcatctatccatttatttgacaggcattcggaaagtacattgtggttgtggggtctgcacttggtgccggagaggcttgttgcaaaacttccagtattgtatgtatcaaagtgctacttttcgaaagtatttttctctctgtcttgaagtcacagagcaactgctggcatttacttaccttctgcactgacagttctctccttgttggctttgaaattaattttctttatcttgacacaaagacccaaaatatgacttttttccccataaggtcagatggcgaggaggaagcagcacttacagtttaccaaaatgggggatactatatttaaacggcatattaatgcatgattatacagctggacaggttgtgctcctctgagagaatgttgctgttgcttttctaaaatttactagtgccgtcatatcatacttagtgggaaaacatgattcagaagacagaagagagggagggagcaaggaagaaaggaaggggaagaaagaaaaaaaagtaaaaaagaaaaacatataccagatagagaacatatccatacaagtatgtaaggtgattaattacttcaagccgcaaaagaaagtgctattgattacctgattccttgaagttaaaaagaaaatcttttaactcatcagcaaagagaaatgtttattgtaagtttcttttataatcccatcttcaattcctgcattttggctagatacatgttatgtacctataataatttaattcactattaggcagcaattttaagccatagtaaaaattaatattgcattttcctatgtttgaggcgtcgacaggacctgtagttgaaaatttgaaccagggagcacagggaaggggtaaaactctattgaatatttaaaaatttacctttaagtcagtgtaagcttggattattttaaggatcgtacttaaggctgatcacttctgtgccagcacatggtgtgttgctggcatttactgtgtcattcattcctgcagcctttaccaatttgtcctgaaagtgcatagaaacacgtcaacttgctaccctgttgggtctatttgccaaaatcctgcagtatcatatttctaagacaagagcacacgtcacaagctttattttctattagcttctaggtgaatacgttcatttatatctcattttaattgaaataggccttaatgaggtagtatattatttctctttaagacaaactggcagaaagattttggaagtcttcgtgtcttcacctcacagaaggaacaaactctgtctgtagatattctagtttctgaaatcagactttgagtgtttttttttttctagaaatatgtcaagtgtgtagttacttggtaccaaatgttactttttaagacaattttatgtaaaattcacttttttttaaaaccagagaagttatatttaaaagtcttcccaaaataaaatgaagggagcaaattcaaagtttacagttttaattatagcaaagctatctctattgctgtaatcaatttatctagaagcaacagaaatgtgattaaacattgaaagattccaaatgaaaattgctttaataaatgcattcatgctattgtttaatatataccaaagaaatgttagcaatatgcattttatttattagtagctatgtgaatctctcaaattattgtggttttaaattttttcctgaattttaataactaatacatgttacacaagaatttcttacataagcatcttaatgtccaagggacatttctaaagtacatatctccatataacaatcaataaactttgaagttttgaaaatcccctaaaaatatactgcattttaaaactcttaacaagctaaaatgtttgcaaatgtctttctgagcctcaccaccctttctgtggtagccattctctccaaattgcttatgtgaggagatggtactgggaacagctcaataattcaatcctggttagttttgctttacataatcttaaacacaaataggtatctaatccctttttccaaaggaggtagatgttttatggttgcaggacacagctagtttataacgtagctataaaccagacttttttcttgaaatcagctatagtctgggtgatcctccaaggcagtcaccttgcgttggatggttcatggatacataacataataacatgtgtttccatgattgctgggacagacggtgggcaggctgggcgtttgaaattggcaactaaaggtaaccagccagcaaagacccgagtcagtgtcactcaggaagtattagctaaagtgagttacatgattatgcctaatatcaaagggatgggatgtttactcctcgtagcgaccagaaggagaactatgtcctgatcagaaggagagaacaaaagtaatgtcaaacacagaaatgttaaaattgaaggagaaaacaatattctaaaaaaaggggagtgagttatatttcaatcttttaggactgccccaaataactttatttcatataagacacaaattaaggtaaaacgtaataaaaccaatcatatcaggctaatggaaaatgaagatatctatataattgcctgaatttccaagccaattattacagataagtcaaggatttgtaagggcagatttcctttttctcatgtctcccattgataatacatatattgtcttactgtttttatttttaaatcaaagttccataagcttctgtaaatttccagttctgtacaatgtcaaccactgtgttagatggtgggatacagaaaactagacatacagtaattctgggaaccctttattaagaaattaagatctatcctgtatttacaatggtcacacatcaaataaatgtaaatttcacagctgaaattgctttccttaatttatgtactttaacactttctagcacctggtaaccttttgtatctaaaagtaacaattatatggtattatccacaatataaacgacctaaacattgatacctggggtaggaaatattaatgtttctgggtttggtaggaaccagtctttggagagacaggtgataaatgtaattgtgttctatccttgccaatcctagcaggggatcttaaactagaaagaatatatgctgctgcaaggaattggcttactcagctgtatgctcggctgtagttttgaacaattttcagcacagctgtgctgagtaaactaataagctaacagtatgtcaaatttctctttaagcgccacttctcaaaatgatgtgtgcatgtatatgtgtatatatatatgcgtgtgtgtgtgtgcgcgcacctatgaatgaaatcagaattacattattacagtgttcagaattggtgttaatatcacaccaattgcatatgacacttttacatgaaataaattttgttttaatatttgtgtgattagttagcacgagatgcctaatatgtgaaaggacattgattgcatattggaattggagaacgtctgtccatgcctacgttttatgtgatatgaatctagaacctaaaccaatcaacgcaattgatgtaaggtcacacaaaaacagtgacagagctagggcgagaaacaagctctttttccttggccctgtggggtttgcttctgcaccgtgcacccctgttcctttcttcattcacctcatcagtgcttaacgtgaataaaatgttaaaattcctgatctcacaacagaaaactgtagcttcactcaggaactaaattagctcttgcaatatacttttactacaatagctggagaatctactgattctgtggtgccaagtgcctttgtaaaaacttaaatttgccaatggggatgtttttggcagtgagggaatgtggttgtggaggtggctgaattctctctcccaccatcatctcctgtggcttataataaccatggcttagggtgaatgtcaccccatttgtcaagtgcgggctccagaaaaaataaaaataaaacagaagctgaagttttctgggagatgtgtagaatgatgtgtcagttaattgaatcagatgaaaatggtgacaaatgatgaaatcatttgtagacaaatggactgaacacaccttgagactagcttttttcctttctacactgaggtgagtgttacctagtgcttctgaaatatcaagacaggagttccctgaaatatccagcatctcatttttcacgaccctatgcatagttagatatatctttgtgaattaaacttctaatagaaatgcctatttcttgaatatctgttatttaggaggagtcctttaataattgtagtccttgctggggctgccataacaaactgtgatagggtaggtggcttaaagagtagaaatgtgttgcccatggttcgggaggctggaagtccacaacgacggtgtctgcaggtttggtttctctgcagcctctctcgctggctttcagacagctgccttctcactgtgtcccctcgtgctctgttccctttgcaggagcttctctgatgtctttctctgtgtgtccacatcttctccttttataaagacaccagtgggactgaattaaagcccatcctaaaggcctttttttgttgttgtttagatagagtgtcactttgtcaccccaggctggaatgcagtggtgcaatctcggctcactgcaacctctgccgcccgggttcaagtgactcttatgcttcagccttccaagtagctgggattacaggcatgtaccaacctgcctggctaaattttttatatttttagttgagatggggtttcaccatgttggcaggctggtctcgaactcccaacctcaggtgatccactcacctcagcctcccaaagtcctgtgattacaggagtgagccagcacctaagggcctcattttaacttaattacctctttaatgggcctatgtgcaaataaaatcctattctgaggcactggggattattatttcagtgtatgaattctagggtggcacaattcagctgaattaaaaccctgagtaacaatgaattcctgtcagccccttactatgagccagttacttctcagcgcgtttgtggatagcctctttcgtaaatgatcgtgcacatctgcaagactggaattagaattgttatttcagagagaagaagctgaagttcaggagggccagtaacttgctcaggctcacataattatttcataaatatctctgagcccctatggtgcacttggaacaatgttagtagttatcgatgtatcagagacaatcagggaaagccccagctcttgcatagtcagagaagatagtaaataactaaataaccacagacagtgataccggatggtggcaaaaattccgtagaaaaataaaggggattgtgcacatatgggaggtcaggacagtttgttctgatgagtggggtttgagctgagatccagtggaagcaagagagcaagacatgctggtcagcttcttggtgacgggcactccaggcagtgccaatggcaacgggaaagtctatgtgtgcgtcccacgtgggcagaggctggggtggaatagcaaagtgggctgaggatgagggctaagaatggagctcagagaggccacaggagccaggcctggtgagcatcctgtatcagggaaggatttctacttttgccgctgaggatgtggggtgtgactcgggagctttacacagacttgggtctgaaagaatcactggagatgtagtgtggaaaacacttagaaaatgattttcatctgttagagctgctggacatgacaaggtgggatctttggggaatcttggtagaattctgggtatatcttgaaggcagagtttggaggatttgctggtgagtgtgagaaggagaggagccaagttggaatccaaggtttcagtctgagcaaatggacaaatgcatttgccaagtcctatttatgttaacttgcagataagtatcatctgacatatctactcccttagccctagttcacagtgtcatcaccacttacctgagtaattataccaatgtagatgccctgcctgttgtctttcgtcagtttaggatgccatgaagaacctctaagaactatttagtaaggcataactcttacatgctagttgttgcccctttccaactcacttgctctcggaaaaaaaggactggcatcgcagagctaagctacaaagcaaagacttgagccccaagcctcagttcttgagtcctacattaaactttcacactgtgcctcactgacagttgctggggcagtttggcagggatttatactaagattagattaaataatgcatttggccgggcgtggtggctcatacctgtaatcctaccactttgggaagctgaggctggcagatcgcttgaggacgggagttcgagaccagcctagccaagatggtgaaaccctgtctctactaaaaataaaaaaaaattagccaaaaagcacttgaacgtgggaggtggagattgccctgagctgagattgtgccattgcactccagcctggtgcaacagagtgagtgtctatcttaataataataataataataataataataataataatgcattgaaagcaaataacacagccctatttttttcattaaaaggaatgctgaagcatgtcttttagatacgggatgtctactgctttgaatctttataaatgaaaatagtatgtgctctagctgaatgctttttagttttaaacttgggtccaagtaaatggtttaaaaattaactaaaacaaagttacctttgctcattatataaaaaatctggaaagagcttaaagttcattgatagcaaactatttagggaggagttctaggtagatattcaaacacaaaatagcagtaggcatcccaatacagagagatgacatgaaagcattggtgaatttaaaatgtaagtcacagtatagattgtaaagtcctgtaaagtttgtttgtattaactgaccgaaaaaaaagaaaagcccagaagaatactggtcatatttttttgcaaggaaatcaagaattaaggaactatatacatgctttttattccatattttctttattatttgagttggtttttccccaaggctatatcacatctgtacctaaataaggaggttaattaaaaacaaataagataactgctatttatacatttacatagaaaaattacaccgttttgaaattccaaagcttctagtagatgcaagcgccagtattaagtgtgagagaattacacggccacatgcgtagatctcacaaatacagaaaatatcgtaaagataaagagttcatggtggggtcagagcaaaggttattacacaaaattataggtgttttatttcttcctttcgttagaaccaaaaaaaattcatgtttaactctgtgatacatccatttattcattgtgtccacaagaaaaaataaatgtaatagcagcctctttctttaccctgcaatttgaatatttcagacttgataggcttggctgtcctttcaatttatgatatggcagcctcatgaatatcggcattgataaaatatgttcttttaataaaaacaattcaaaagaataagtccacttttaaaatgtgtatttgtttgtttatttaggttggtttatgagctctcacttttgtagtcattaaatataacctggaaagaatgcattgctaaaactgtaataggaaaacaaaaatataaacctctggctggaaatgcatcaaatgaccagggaaataaaagatatgttttgcatactgagcatgacagaatgccatttcacaattacaaaatgccagatagaggccaggcgcgagggctcacgcctgtaatcccaacactttgggaggccgaggagggcggatcacgaggtcaggagtttgagaccatcctgaccaacacggtgaaaccccgtctctactaaaaatacaaaaaaattagccctgcgtggtggcgggcgcctgtagtcccagctacttgggaggctgaggcaggagaatggcgtgaacccgggaggcagagcttgcagtgagccgagactgcaccactgcactccagcctgggagacagagcgagactccgtctcaaaaaaaaagaaaaaagaaaaaaaaaagaaaatgccagacagaatacccacgtttcagaataaggaacacaagactagaaattactgagttttaaatattttatggttgattttgaaatgattaacagtaagttctgtaggaaaggtatattttagattgttttacaaaatgccatgtatttaactgctaaagaaatgtcaggtttcaacaggagtcatgtgacaacacatgaccccgtcaaagaccacctacttgtgtctggaaattaaccttcaagttgaactcttgagccccttcccagaaccaaaagtgggccacactgcaaaaaaaaaaaaaaaaaaaaaaaaaccataaaactggtattcaccatgttttattctctgattaaccatagtgatgttgtccttccttgtgtctgctgctcagggactaaacattcagaaagacttataatgctagttcattctgtcataatatattcaaatatgcttgataacaacccaaactatttaaggtatgtagtaattcaagtcacttgctcattcattccagaaatatttattggaggtatttatgcaatgtagacaccatggtggatgcaaagattcttccgttgcataatacagaaaaagagacgggatttgaagagacaagatttgggttcaaatcccagttttgtcttgtgctggttggggaaacttgagaaacatattttcttcccgaactgtaataatcttaatatgacaaatgaaaacaatatgatacatatgtcaaaaagtttgagtgattttaaaatgtttataaaagttttttgtaggtttttttttttttttttttttttgagatggagtttcattcttgtctcccaggctagagtgcaatggtgcgatctcggctcactgcaacctccacctcccagtttcaagtaattctcttgtctcagcctcctgagtagctgggattacaggcacgggccaccacaccaggctaatttttgtatttttagtagagacgggttttgccatgttggccaggctggtctcgaactcctgacctcaggtgatctacccgccccagcctctcaaagtactgagattacaggcgtgagccaccgtgcctggctgtaggttttatacttatgtttactattacatcttttattgaaaatatcatatagatggtttttaattcaataaaaatagaacagaaaacgttcaaattcttgagaggaaaattcattttacatgaacataattaggatactgggatgaaaatatcttagtaaaatgatacaaaactgtttacaactttatcatggtcacatagatgaaaataaaacttacatgatcataactcaaagtggatcctacatttttttctagcagagattgtcaaatctgtattcaacatcgagtgtctggatgtttatttgtgagcctggatgcttgatttacattgtcagaatcatgacggcagaaacttgtcttgttcatcacttttctgcctacagtgattgagacttcaagcaagctgagatgtgacagaggacaaaaatgaattctattataaaactttcttaaactatcaaaggatgattcagatgcaaggttgagaatagcttgctaagctactttctttcctccatagaacccaaaccaaagaaacctatacagataaagtttggatactgcctatagtttgtgggccagttacttcttcattatctcatttattattgaaaactcattattggaattattatatttctaccattgggacactgaatcttggagatatataatagaatgacctttccaaggttccttggtaaatttctgtaatcatgctaactcccaagcactgatagtcccactgagtgctctccgtggataggtataccaggagagaacatgtgagtgcaggaagcaatgtagaatacaagtgtagtgtgtatgtttaaactcaatgaggttatcacaagggcttcattttatatttatttttaagttatgtgggcacatagtatatatatatatgaatatatatgtgtgtttatttatatttagagagaaagtacataagatgttttgacacaggcatgtaatatgaaataagcacaccatggagaatgtatatccatcccctccaacatttatcctttgagtatcaaacaatccagttacactctttattttaaaatgtatgccaaccctttaagaagttaactgttcatgctcctaaccaatacgaaagcatcaactcacattgcctttgaggatgaggcatgagtgagtcaagtgtgaagggtagaagaaaggacagctgtttaatgaatggacacttgtgtctactattatgtaactattgaaagaaaatgacagtggtcatctaaaactgaaaaattgatggtattatatattttaaaaatatttcccctaattccatgctagtataattgatatccctttatttcaaatcattttttaagattgttcccctaagttggaaaattcttggagttatgcctgagtagtagcaccccatctagctgaggtggatgctagggactgttactgttcacattaatgtgagtatttctgtgatggaaagtgtgtaatatgcatatacaccaagactaggaataagaagatttaagggagtgagagactcttttgaggcttagagaagatgccagttaaaactttagcactaggaaaaacttggtaaaggaattcctcaagtcatttccctgtgtagaaggaaacacttcttggggtgactttggtgtccttcagtagccttctttacacctctggcaatctaggggcgtgagaacacagaatgcatataatgggctggtctgtcatctgaaggtctgcaggggctctcagaaatttcccaggctgcaccatgtgaactgtggacaagatgtgttgtttcttgttatctgcataccttctctcatgagcgctatcaatagcttttatagaaaacaaatgtaatatgtgcacttaaaaactgaaagggtgtgaatggtttgcccagcaatgtaaaacgagtcaaattttaaggtaggaagaatacataaaagtgataatatcaagttattagaagttcttattgctaaatatcatttgacctttaatttctaatttttctcaagtaaaacaggattttgtaaaatattgtgctatatataagcatacataattagaagtgctagtttgagatggggtgggacagggataggttatgtaacaagaatcaatgatgcctatttatacctttaaacaacacattcagtgtacgtatcatctgccattagaactgaaggtacattaaaaaaacacagacagacatgcacgcacacactcgcacacacaggcagtacttcaccccttctagaatttactctggtgggagatacctgcaaggcaatgggtaatctcaccagagtgacttcctggatcatgattacaaaagctcaggtgctctgggtacaagtgaagagggcagtttatccatgctgggggattcttgaaaggcttttcataggaaggaaattgcaggattggatctgaagcaaatttggctgagtgaagagggcaagtattccaaacagatgtgagggtacgttcagaaggctggaggtggcttcttgcatggaaggttcaattctgagtgaatacagtcactcttgggttttctctcagattgagtaacgttcccttgaacttttataaagtcctctcgccatgatctgtgaaaacaacatataagaaaaaaatggctggtggagaagaataattactcagaacaacaaggaacacattttgtcttagggtgagtaaacattgcatacacattcctgtacacagagaccgacacacacacacccatcacttctgtgggtaattcacacttgttggttatccttccattatctgagtaaaataaaaggtattttggaaaatatgcattgtatgttaataagcatctgaatttctatgttcacagtttaaagtgccattttaccaactatatagtgattccaacatcacaaacttacatacagagaatactgtgttttcaggggacagtataaagacattcttatctttaacatgatcttaaaaatataaactcccattaattcacattatacatgtttcatattaaataatgataatttttgagatagcttaggaagattaaaacataatttataatggaatttgaattttcctgagtatatcctaaatgtgaaatgtgtttagcacccccactcagattggctgacaataaatgttgcctctggctggtggaagaggtttctgaatggaacgtgagagggagctaacaagtcacttgaaattgcctgtttctgaccctaaatcaccatcataatcatcataatttctttctttcttttactttcttttcttttctttctttctttcttcttttttctttttctttctttctttttctttctctttcttttctttctcttttctttcttccttcctttctttcttcctttctttcttttctttctttctttcttttctttctttctttgtttctttctttctttctttctttctttctttctttctttctttctttctctctttcttttcttttcttttcttttcttttcttttcttttcttttcttttcttttcttttcttttcttttcttttcttttcttttctttcgttctctttttcttttctttgacagagttttgctcttgttgcccaggctggaccgcaatggcacaatcttggcttggtgcaacctctgcctcctgggttcaagtgattctcctgccttagccttctaagtagctgggattgcagacatgcaccacccacgcatggctatttttttggtatttactaaatacagggtttcaccatgtaggtcaggctggtctcaaactcctgacttcaggtgatccacctgcctcagcctcccaaagtgctgggattacaggcatgagccactgtgcctggcctcaccattgtaatttctgaggacaggtccccagtaactaaatccttgattcctgagaaaaatgatcttgctgcagacatatacttttgttttcaaaactaatgtcattaaacggattttcaagatatgagtgaattccctagatttatactgccagcatttccatatgcattttctctctaaatactttgttattaatattctaattttcctatgtgtagactcaagaaattgacttatcttgaactgccttggatcgctcatttcagccagtcataagtataatactttctagaataagtctgagtagatttgggggtgaagatcctgtcctgtttggttcattagcataagactcttagaaaaggcattgactcaacattacaaatattatatatacaaggtaggaattttcatgataacctaccttgattgatctcaacattgtcttctatttgtcttttcattttattttcctctactgtcttagctcttttgtgctactgcagcaaaatacctgggactaactgatagagaacagaaatgtatttctcatggttctggaggctgggaagtccaagatcaaggcattggcaggtctggtgtctgttgagggctgttctctgcttccaagagaataccttgttgctgcaccctctggagggaaggaatgctctcccttcacatgaaagaaggtgaaagggcaaaaggggatgaactctgggtcatgcccttttataatggggggacctactgtaatcacaaaagagcagccatcacaggctaatcacttattctaggcccagcttccaatactatcacattggcaacacccagattttagaggggacagattcacacctcctatgttaattagtagtacaatgtactggagtatcgatattaaaacttttcatattatggtacaaattgttactacatttagtgtactgagtactgggtattgaatcattttattttatgtcaacattttatgaaagatctggaactaatgcaaacttctgccttctatcaaaatgaccgataacatgcttcaaatagccagggaatggctaatagaaaatatacattaaatcccccttaatttttgttattatattggaaattttggtcatatttctaatgaataaaatttattagattatttgtttatgctaaattttaagtaccagcaaagtttcatagtaaggaagaatttaacatttacatctaacccgtggttctaaatatactctaattgacagaactcttctttttccctttgggcaagagattatttctgaattgtagctatgactaaattacaaagtgttttaatttcaagtacgtttcagttttacaggattttaattttactttagtgattttaactgagtatgtttccattctaactttatagaagtaaggcatgacatgttacataatcattattttctctgtttaacaaactactacctcactgaaaaccatggctctgttacattcgtccctgcacctaagtggcttatcttttggtacatgtattttaggtgcccaaacaactcaatcgtaatagcaaaggaaaaaaatataaaccaaacatacatacaccccccagaattttactactttttttaaaactcacttatttaaaattacatgttgtaggggtgtgtgtgtgtggtgattatatgaacaatatatatctgcatatatgtacaaacatacatattcacaagtgtgtttatatataaattatttaaaattccatatgcacatacctgcatatatgtgtggaaattaattactggaaagttcttggtgaaattacgaaaaatgtattagtcaaataataagtttatttcactgaaatagtgagattgggtcaagaaagaaaagatttatcaatctgaagtaacgtgattcagctatcacttttcagctttgtgtctttttaaagcacaactcgcagtgcttgtctagacattggaaattggctttttttttcacatttatatccctgtcctttttctaataaatattggagcagacatacacattgtgcagaaagttagaaaatgggtaatgaagtccaggtggatatacagaaggacaagaggaggatattgtgcaagaatcggcagaaaggtctgaatctgggaggaacacccacctttcactctgagatttccagcaaaaagaaaagagagagaaggcaatacactttgtgattttcgaagctcataaatacaaaaataagtctgtcccagaaagctcacatgcttcgcacatggagggggccttgagtgatgtccttgatccctcgatcagcatcatccccttcgtaatgatttcaactcaggagtcaccaacaccaacacgggattccattcaaaggaagaatttttcagggggcagttttgtaatagaatacatattttctttttttaaaagtattgctaactcataatcagagaaataagactttaaacatcacaaagtctagtattattttacaagtgatttttctgtcatttcagctttgttatcacagacagtaacaatactcactctactaaatagaccttagcatattttctgtatcaacttctgattgtaaatgccttaagagcagtgacctgttttgaatcgtacctagccttccaggcccatctcaaatgttacagtctttggaaatctcctcctccatctgaaccactgccacactctgttcctatcttgcaacacttttcacattatggcttttattattaggtattgtgaacttggcatccttgttttgtggatagtcacattctagggttcccactgatacggtttgtctctatgcccccatccaaatctcttattttattttttattttatttcatttatttatttattttgagacggagtctcgctctgtcgcccaggctggagtgcagtggcatgatctcggctcactgcaacctccgcttcctgggttcaagcgattctcctgcttcagcttcccgagtagctgggagtacaggcacccgccaccatgcccggctaattttttgtatttttagtagagatggagtttcaccgtgttagccagggtggtctcgatctcctgaccttgtagtctgcccaccttggcctcccaaagtgctggggttacaggcgtgagccgccgcaccctgccccaaatctcatgttgaattgtaatgcccagtgttgaaggtggggcctgattggaggtgattggatcgtgggggtggtttttaatggtttagaaccatccccctactgctgtctcatgatagagttcacaggagatctgcttattttaaagtgtgtagcacctcccacttctctctgtcttcctcctgctccagccaagtaggacatgccaactttccctttcccttccaccatgactgtaagtttactgaggcctccacagccgtgcttcctatagatagtctaccgaacctgagccaattaaatctctcttcttcaaaaattacccagtctcaggtggttatttatagcaaggtaagaatgagctaatacacctactgaaccctgtacacctgcggatgcctaatgacatgtctcacaccctgttgacatgaatgttggtatccatcaccagtcaaaaactgtaatgctgacaaaggattcctttctgtcatttcttgcaaaagtaaaatattctcagggattctgttgaatgcattatctacttttaatatagtaaagcctacgttagcatctagctgtcactttgttaaaatatgaaccttgatacctatttattctttgcgatatcacaatagttatggtgccttacaattcattaaataaaatcagctgtaaaaaaatgcctagactctttgtgtaaagtatttttattggaggttattactacagagtttccccaagtaggatgatctgatattttcaacttacatttattgagcagggcagtatttgagtgccacgtgcattttctcattctaaacaactgcatttagctttcatatttccatgaggaagaaagaaaacatacattgcaagttgaacaaaaccatcttccctgacaaacaattgatttcatgtaaatgaaagccatatttatatgtgcatatgtgttccaatgtactctgaatctataaccagaatacttttttcaaagggttttgccatatttaaaagttgcccataaacattgtcaacaatatctgctgatgtgaagagcaagttcttgatgtgatattaccccgtgttcttgtcatcgtagtgtgccgaaattctatttagttttataattgtggtcatctacggagctgcctcacaatgctcccatggagaggactctactttcttttataaaaacatttttatgccctgagttatcttcctgacttcatcagactcctgctgaagcaccacctgtctttctggcatatgaacgtaatctgaagtgctggcgttgcctttccagggcaaatctagtgtattctatgaacgaggggcaacaggtgtagctcttgcaagctggaccagggatgggaactagcggaagagaagatgttcctgtggaagagatgccacttgcagttttatacccactccccatgaagagccactcctgcctggcacttatggcttgctgaaaagatctaagcaactttgaaataggcaggatgccattgtgacagatgggtctccgtgtggccaagatgccaagtattctatgcatcaagtgtctctgctaaaagtttgaatccccgccaggaaaatccaaatggatgtctgtctccaaacccggacataatgtttagggcgtgaccctctcccgaaatccactgccgccgggcgctaacgttccctcgtccgaggtctgggtgtgaaggttgggaactgctagcccagagttcaatcggatgcaacagtcccccagctgtccctgctcctgccctctactgcagacgcaggtccatgacacctcagagccgtgctcctgccaggcctgctttttgtatggaaacccaagaaaaataaatatatgttggttctgaggaaaggaagattgtacgcagatatgtggtttccaatctatactcgacaacacagtgtaaacaatttcttatctaaaatacggatcagaatctacgattgtcagactatatgtaatctactttagcaagagttagctttttaccattgcaataaatccacacgggaaagtctgcttttgggaggggtgttatgcctatgaattggagtatttgtgttagatttttcttgttatacatattttatatatatgttatgtataaatacacaggtatatgtatgtgtatatatgcatttctcttatatatataatcataagcatgcgtattccattttcttcgttcggcaaccacagttggtaacacttgactcggcctgaccatattacatctgagaaaccgagtgtatttaattcaatttctattccctccacacgtgcagtttctcatatctaatatgaattgaattaaatacggtagctattgcctggtaatttcacatgaaacggaatgcgtttcatcatcatcatcattttctttggataaatgttctgttcctgttttctgtgacttgggaataccccatgtctttcttgtgagttcaggaggtgaaggtgaaatagcagtaggtgaaactccctgatgtccacaggcctctgccacagctttgtcttacattgtggttacatgggaactcatgcaggtagtgacgtaaactgagaaaacacattagcctcttaagtgtgaaaacgtctcatgtttattactaatttccttttccgagttcattttcacggattagtgtccaaacagaggatctgctacaaaacttgcagaagttaaaggcgaccgttatatttctatcttctattttttttttttttttttttctttttgggagatggagtctcgctgtctcccaggctggagtgcagtggcgcgatctcagctcactgcaaactccgcatcccaggttcacgccattctcctgcctcagcctcccgagtagctgggactacaggggcccgccacctcacccggttaatttttttgtattttttagtggagacggagtttcaccgtgttagccaggatggtctcgatctcctgacctcgtgatctgcctgcctcagtctcccaaagtgttgggattacaggtgtgagccaccgcacccggccctatcttccaatttttaaagtgaaatgtttctatttcctctgcacactcacttgcataattccatagctttgtaacagaaatgattgcacctgtaatactatagagtctcatgactccgtgcttttgtttctttaactttatatgcacttttcagaaagaaactgtgtagggagctcaacacaaatcaatcatccataaatgtaaaatcttcctctctgagtaatttaggtatcgtactaagatttgtttcttcaggaaatgtctttaagaaactgcagcatcacaccttatatgtgaaataatcacagaatttatagtttaaaatcttaattggctacaattaattagagccctattttgtatacattcctttggtaatcgcattaattaagaaggatgcacagtaatcgggttccatccaaacaataatatcccttaacagctgctggctggagaagctcttctggttatgaagccccaaagagtctggtgggaaggttggcgtgcaatttggcagtgactccctaattctggtaacacatggacaactccctcgcttgcagatttgtcaatggttcttcctaagattaattgtagtcaggaaaagcatgaagatggaattctaatctgcacagtacatctggttgacgcagaactcagtcttggtccagcaacacctactgcaaaacatatggatgggagcattattaaatgagctgtggacgcatatgttggtggcgttcccctgtagagctctttgagggcagggcttctgtttaaaataagacatatgggggtagttttcattctctatttgatgctgatggacaatggccattaatagcattcagtgaagaaatattcactgagtgtccaagcactttactaggaattaggaaaacaatcaagaaaaagcaatggtcccccgccagaaacattttaagggacagaggtgaggctgtaaacaattattgcaagtaattataacaccaaatgaggatagcaatagaatccacaaacctgtggcaggaaagaagagaaacaacttgtgttgcgtgacggagtttgggatgtacctaacagcaacgctactaggtttgcaccaacctaatctttgcaagacccactgtcctgtgcctgttctgagtggtggactctgctttgatctgtgatccctcacgattttttttaaagcagctggtgctggccacttgtgggggctcacccctgtaatcccagcagtttgggaggccgaggcaggtggatcacttgaggtcaggagttcgagactatcctggccaacacggtaaaaccccatctctactaaaaatacaaaacaaattagctgggtgaggtggtgggtgcctgtagtcccagctacttgggaagctgaggcagtagaattacttgaacccaggaggtggaggttgtagtaagccaaggttgcaccactgcactctagtctaggagacagagcaagactctgtgccccccctccaaaaaaaatagctggtgctgtatgtcattttatgtcatttggcctccaaaatttcaaactaatagaaagtcactggtggttattctgtttcccttagaccaaaaacagaaataaatgaaagtgctaaactctttggttcctgacctacatgtcacaggtatttacaaaggaagccaaacaaacttgagctaaaataggaaggcaggcttttgagagtgttcatttcagactaccccagtgaagtcactaaaggtgggattgagacgagcttatggggcatctggcatgaagcctctggcactttgtatggaaagagttttctagaaatgctctcctcccgttttcaccttcaatccttgtccagcctttctgcaatggcattgatctagacaaccccacagcaagttttcctgtgaaaagaaaaaaaaaaaaaaaagcagaaaatgatttcttaatgtaagaaattcttccctcttcttttattagattctgtttctgtccacgtcattttagtacaatctactgccttcgcatgttcttgccaataatttcagtggtagctctggaagcaggtctccacctagctcagtaagaggacttttctaattttatgcattgtctttttcttttccgttcttttcttttctttctttctttttttttttttttttttgaagctatgttgagcactagaaaagtacaggatctgaaattggaaagaactgggatttaggttttttctttttctttttcttctttttttcctttaataaaggttacagaagaaagaccaaaagagtacgtacttcttgtggagaaattattaaactgaactttctgggtggggcttaaaatagtacaagctaaaatatgttgccacaaaatacctgtctagtaatttttctgatgagcttctcagaagcctcagagaggaattgtcaaatttatttggagagaaatgagaaaacaccgtgaagtttaatgagcaactccaatctagaagtgattgatctggcggcttctatgttggaagcccaagaagaaaccaacgtgatttaccagtcccttgctagagttgattcagtttctgggtggttataaaaacttatttcagtctatttatgcagacttcgaagtagttatttagtgtgtaaattatatgaacatttcctcacaggaagttaaacgcttctgtcaggagagctctgagatccctggatgcaggtagagggcaggtattagcagtaaagtttggccctgacttgggattaaggaaaattattaaggaatgttaatgacattgaggtatagacccacaccttaatcacatcctatggaaaagtgtattcatgggacctggaaaaatatgctgtgtcagaggtcaagggaattacctaacaaatctagagaaagaccaacagacttttccccagtgattttcaaaaataattgtctttcatctgcatattggttaagttattctctcagcacctgatgaaacactttatccagtatgtataggcagaaattacgactggtggacaaaggtcatttgaaactgatggagcagacagaatttgaggaaaagccaaaatctttaatgtgcattggtattagtccattttcacactgctgataaagacatacccaagactggagaatttacaaaagaaagaggtttaatggacttacagttccacatggctggggaggcctcacaatcgtggtggaaggcaaggaggagcaagtcacatcttacatggatggcagcaggcaaagagagagtttttgtagggaaattcccccttatggaaccatcaggtctcctgaggcttattcactaggtgagaacagcatgggagagacctgaccccatgattcaattacctcccactgggtccctttcacaacacatgggaattcaagatgagatttgggtggggacacagccaaaccatatcagtttgatgactatctaatgacatttatcaattggatgactatattttcccaccttataaggtccttgttggggtgagacaatatataattatgtgctttattattttttaacacttacaaagaatatcttaaaacacatttctatgactgaatgtttgtgcccccttcaaaattaatatgttaaaatctaatccccaaaatggtaatatttggaggagcagactttgggaagtgattaggttatgaggagggagctttcatgaatggaattagcgtctataaaaaagcttcagagattccttgtcgtttttaccatgggaaaacacagcgggaaggtgccttctagaaaccaggcaagaccctgcatcagaggacaaacccgctaataacttgatcctggacttctcagcctccagaatgtgaaaaataaatttctattgtttataagcaatccagtttatagtattttttatagcagccaaaattgactaagatacatcatcaacattgacagaaaaagcttataaagttgtataaatcaagatatatgcgttgactgttcactgtgatgagataatacaatggaagtgtaaatagtcacatttcccaagatgaataataatttagtccagtataacaagtgtgtgtatgtgtataatgaaacacaatttgaaatatatgttctgcaacattataacattaaaactgatataaaaatttagacaataattaagattcagtcctaagtaaagtctggttttgtgagttacagaaagtgggagttaagaatctgacatgctattggttattcatatatgctgaaacatttcaatcattgataaagtttagaaaagataaataatatagtaaaatcatccacaagacttcagtttcagctagtcgtgtaaagggctcactcccatcctcataagaagaaaaagctgggcaaaccccaaatcaatgacttctctgaacccatcagagaactgaggttgcagttaaattgccacctggaaatgaaggacaggtgggtccacagagtcacaaccaaaacaaatgtacatggatcagagactataggagctatatacaggtgagatcacttaaatggtcactttcatgagctgctggaagcagtggtgtgagaaggagaaaatccgggggtgtgcagtcttaggaggcccctacactcattgcctttacttctaggaaccccatgaagtgctcacggtgaaaattccaggaatatcccttcttacctctggcaggtcaaggaaaaatggacattgtgaagtatcctagatccttctacatcaggaaggctttctctttagggaaaaatctctgctagaaggttatcagggaagggtgttacttccatgtcagacagacccctttagccttcctgtcttgctagtggaaaattcatacttagtgggtgtcatggcttcaaggaaataaaatgggatttctataactggaaaagtagtagaaggcaaggaggtaaaaggaggtattttgctgggaaaattctcagaaaagtcatagccctgaaacacaggatcactaaaagactcacagctagtaggaaggttataaaacactctaccatccctcactaccacagcaacaggcctcctgcattataagagtggattacagcagaaggccctgccagggacagtcctctctgagaagaaaatcaaatcctctgacacctacacctacagcaagcattaaacataatccaactcctagtccgattaacacaaatcttcatgctaaagtcctgcttatcacattttttattaaccaatacatgtcagccttttaccaaaaagaaaacgagaaaaagcacggggcatgctaaaggcaaggaaaacacgttcggaagaggcaatgcagtggaatgactgagatttgagagatatgttgacattgccagtcagggaatttagaacaattatgatttatcagatattttaagtgagtatgattagtatgcttagagtgctaatgggaaaagtagacaacatgtaagagcagataagctatgcaagcagaaacatgaaaactctaagcatcaaaatgaattactagaaaataacatggtgacagaaatgaagaatacctctgatggactcattgctagactgaatacagcctagaaaagagtctggtggactcattgctagactgaatatagcctagaaaagactcggagcttgactgctgttgaataaaaactctctacattgaaatgaaaagagaaaaaagaaacacaaaacaaagaaaaaaaacagaagagaacatccaagaactatggaatggtttcaaaaggtacaccgtaaaattcattggaatactaaaagaagaaaaggagagcagagaaagatagatttgaggaatatactgggagctttccaaaattaatgatagacactaaactacagaaccaagaaggtcagagaacatcaagaattataaatcccaaattatctacacctacctatatcatatgcatactgcacaaaaccagagataaaggaaaccttgaaagaattcaggaaggaatactttaccctacagaatagcaagtataaacactgcagcaaatttcttatcagaaactgcaaacaagaagagaatggagcaaaatatttaaagttttgaaaggaaaaatacaactacctagaattctgtacccagcaaaattatactgcaaaagtgaaggacatagacgacttccatggagaaagaaaaccaccttaaattaatggaaaactattgtacattccacagaagaaaagtaattattttaaaagtaataattcccagatggtgtattagaatatctatgcctatatctgagtcataaccttacttttattttctatcaaatgattttaactcacaaaaagaaacacaattttttgttatggctgcaggatataattaataaacaatggccaaagtgagatggctattgtctgtaatcccagcactttgcgaggctgaggaaagaggattgcttgagcccaggggtttcggagcagcctgggaaacaaagcaagaccccatctctacaaaaaatgaaaaaaaaaaaaaattgccggggatagtggcatgtgcctgtggtcccagctactctagtagttgactaggaggatcattagagcctggaaaattgaggctgcagtgagccatgtttttgccactgcacttcagcttgggtaacagagtgaaaacctgtctcaaaaaaccaataaaacaacaacaaaaagaaacacaaaccaaaaataatttaaattttttttccatttaattctagtaagatgttatgagtttaggatttttatatttattttaaaggtacagatgctgaggtttaggatatttatgtattttgcccaatgtcctatttgcagtaattcatacttgagggattttaacaagggaccttctcatttaggagcccaagctttttgccgttttgtctgaaggttaatagcgagagagttcttttggcttttatagtagaaatcaatgcagaaggtacatcacaaaatggagaataatttattcttaaaagtagagaagtagcttttcactaggaagatttcaaagagagtaaaagttgtggaaaaaatagaaggacagggaaagtgatttaagtaagaatatttcatcattattccctaactcttgcacacacagaaagcagcaattatcttaactgtggcttgttacataccaaacagaaaatagaacattctctcactgttatgttgaatgcaaacattatgatggcactttaagacatatagatgaattaagtcttgaataagtacaattgtgctatatttagtaggcaagtcatttaggaaagactaataggaaaatacctactaatatagtcagtttccacatttactcacattgtgaaactaaaggtactttgaaaaaagaaactcaaggccgggggcagcggctcacgcctgtaatctcagcactatgggaggccgaggcaggcagatcacgaggtcaagagttggagaccaacctggccagcatggtgaaaccccgtctctactaaaaaaaatacaaaaattagctggacatggtggcatgcgcctgtagtcccagctactcgggagactgaggcaggagaattgcttgaaccccggagttggaggttgcacagctgagattgtgccactgcacttcaacctggtcgacaaagtgggggaaaaaaaagcaactcaaaatgtaatagctaccttgaaaagacaaacttatttaaaatatttagaataaaaactgaaaaacaaagtgtgtgaaatcatgtaagaggatgtattcctttgctacaaaaaacttaatgaacacagtccttggtcctttaagttgctggggccagaccacctctattcatccctttgacaactcagtgttctacccacaataacataagttgtatgcaagaatgtgttttaaaggaaaataatacttaataaagcatataaagagtgttaactgaataatgtatttgttttgttaatatttacttggaaaagagttcaggaagtgtcatcttcagaatttagacagcaaatagtttcttctgctagtgaaagggtgattttctagactcaagggttctcacaggaaacttcctttgaagcgaagagtgcaggtagcatctagaaacctaccatatatcatacaaggataatttgattattggtcagctccagaggtgagagggtctgaaagtttcttacagtatattttttaatatgctttctattttaatttatcggatcagacttcctgccaaaagtggtgttgccgaaagtatttgaaggcaggaagaatgaatgggggtttgggaaactgggactggtgaaaggaaagagtggctctgagaaaggcaattagatgtgagaataataattttaaggatagtaagatttcttttttactttttctttttttctttttttttttttttgagatggagtctcgctctgtggcccaggctggagtgcagtggcacaatctcggctcactgcaagctccgcctcccggtttcacgccattctcctgcctcagcctcccgaggagctgggactacaggcgcccgccaccacgcccggctaatttttttgtagttttagtagagacggggtttcaccgtgttagccaggatggcctcgatctcatgacctcgtgatgggcccaccttggcctcccaaagtgctgggattacagatgtgagccactgtgtctgaccgatttctttttctttagagagttagtgatgatagggaatagatggaaataatgtgtgtcctgttttagaatgcctaaagcagaaagtgagagtcttttactatgtgtacatgtatatgtattttataaatctataaatatacactgtgtaaatatatatattttataaatctatctaagagtctaatgagaagaaatggtagcctttatgatattacttgacacagcgagttatccattagactctgggcaccctaaacttcagcaaatgactgaaaatagctggttaatgtgttacttggaggagagataatgcctgtatgaaaatcacagatgagatatcaaatataactttttttttcagagatgtgttcgaatagtactcccaggatttcattccttatgacatttaaaagttgagtatatagagcactaaaaatacaccacagggaacgatcctatgctggcagagaaatgtttgagagcttcagaaggtcccagctatttttaatttctactgtcacactaccttagagtgagtaatacctttgcaaattgtactatgttggttgaagcggcggcatggtcccttgtcccaaagaggccctggacagtattctacagaagtgcttgcaggctctttttcattggaaaataaatgaatacagtcccgaaaggtagtaatttacagatcattgctgatagggatcttcatgccagactttctgtttcatgttattataactgtccaaaataactgctgaagtttttacatattaaaggtgtttttgtttttttaattttgctttaagatcacatttacctgtgttactttcttccattttagttttccccagtacttaacaaggacaggctcacaacactcttgaacttctggttgacttggatggttgggcgctccctggctcactcatatatgtgcttaatgatattcactatatgtgtttaatgatattctgtggctccatgtgtccacagagagggcagtgtaggacctggaaagggtagtaggctctgagtcaggacgattgagccctaccagctgtttgactttgaacatgtctcttacctcttcaaatagctagttttatttgtgagatataagttgtttgttctttgcctgactactgtgaaagagaaatttaaaacccaaccttcttgcatgctgtaggcataaatactcatagatgtaataaattattgattttttaatgggaaatacatttactgtactttcattgttcctaaaatccacagttaaggaataatgaggaattggagctttctatgatgcctaattttaggtgatggttggtcatcatgttatgaccagagttcagagatttgaagaaggtagaacacctgccctgacttcctctgactccagaaatgattctaacatacattggaattcgagcctatcctatcctggttcttttccatggtaagtcctttctcaaatcttacactaatgccagtcctccaaaaaaagtattaaaataaaagaaataaatacaaaatgaagccatatgattttacactttatgagaagatttatttaaattataatagcaaattccgtaataggctcaaggaaatatagtcttcaatgtcaataaatgcattatcggcgttgaaggcatccatgcagctgatgtggttaaatcaagggatgggaagtacttcttggccatttgagtttgaagagccaggctaacagtaggtcctgctgctaagaagactccaggtccttctcctctcacctttccattgtggagctctgactgcttcatctgtgttgctctttagagttgtgggaccttattacaacctttggtataaacatttagtcctgaataacttgcttcaaagaaaggagtttctaatccaagtttacttcataatgttttatcatgtaacaagttgacatttacaggtattttaaattgccaccagagagaccacatgctgctaaatatatctcctgtttcagtattttttgcagttttaaacaacatagctcataaaacattaacgatatacatttgtacaattggtgtatgccttagcacggtatcattctcaagggtaaaaaaagtcactcaactgcttggacttcgttttaaagacatgaagcttcctgaattaaaaccacaggggtatatttaagagctacttatcaaagatggtaattttatccataaagcaattgctaaatggaaatcagaaaggtcagctgtaattcactccagggaatgaagatgacacactaagtctggctgtaagtgcagggttggtcagagagaagcactgttttaaaactaaataacaaatgttcctgtgggaagattgcattacaaactgttcaagattaaataagagtacaaagatagagcaaaggtaagttcatatcagtggaacagtgtatggctgcgtatatctaatacatgacagtattcaaagtttattatttagtttattatttatttatttatttatttatttattattaatattatttatcatttatttattattatttagtttagtattcaaagtttattattatatataaaatgaaatgtgctaaataagtttaggttgcatattgcttgtgtaaaaatatacatgcagtacatatgtatgtatagaaaaaacataaatgataaaaataaaaatatgtgtatgtatgtatattttgtgaaaaggatacacatgaacctggtaactgtgtttactgcctgggcagataagctacagaggccagagggagacacattttccatttatatattttgatatatgtagaattttgtatcatgtgcgtatatcacctattcaaaagtaaatgattaaagtatatgccataaaagttataaagagttaaatagataatcaaaatattacaatggtcaaaggatgttattagccacagcataatattttctaattctaagaagaaaatgtcttgaatgtttcatgtaaaatttgatgtaaagttgacatttgctttgcaaactacattatatttttcatttattcctgaaaagattatagagtagtttcctttcttttttttttttctcctctttagagatgggttcttgttctgttgctaagtggcacaatcatgggtcactgcagtcttcaactcctgggctcaatcaatccttctgcctcagtctcctgagtggctgggactagaggcgtgtgccatcatgccaggatttttttttttttttaatagatagagcgagatgttttgtctttttaatggatggagtcttgctaagttgcccaggtgagtttcaaactcttggcttcaagtgatccttccatcttgttctcccaaaaagctgggttgacaggcatttttctttttaacaaacttcattgatatatagttatttggaagaaaagatgaaaatcaacaaatatacacatatatattctttaatgtaagtccatatagccaaagccacagtatgtttgcatcatagctgcatttccttacagcctcttaaatgatgtttgaggttgacattatgtctttggtatttgacctctggttgtgaagatcaatatctgactgacaatctttttaacgtatttagggtaaatggaagtgtccttttggctggtgggaagtgtatatatatgtcatcatcatgatgctactcactcagatttatcttatttctttgagaatatgtaatcacaattgtgcctccctccaaggaaggcacctctccctatcatttacttaccgtcctctatgctaatatgattcagcatcctctatgctctatgctaatatgctagtatgcatactgccagttggattttttaaagctacaaagagccttgcaaactttctagttttaaattaaaaatgaagtatggggacaaaggctaatagaagtgtccggaaacgtaaagaaacatctgacattttctttcacttttttggtggggagatcatatgaattcttacagaggtaattttaagctcacaaagatggaaaaacataattgatgtagctttgttttgaaataattctcaactatgtattaaattctatgaaaacttgaataatggaagaagcaatgagctgctttcaagtgtagaaatcctaactgcaatagtcttctatagataactacacttctaataccattatacctgaaattttgtgttcagatgacacaagcggaataaaaaattatcacaaacttaacaatgtagttttgttttctagaggttaaaaagacaacttttgaggaagcgtctgaaatatagttgtttctacaaaataaaagaggttgatctatactaacttttggtttaagaaaatctttcttagcccagatgacactttgaacatgcaattgctgtgtaatactgacgagggtatactgttgcccaaaataataagttgaattgcttcaactctgtgtaatctccttttgacaatagtttaatttgttgaacatcggcattctttactttcaaatagtatggtgaatcattaattcattcaaatatatttattaagacttgccatgtggccgcactgtgctgggcacttaggatgcaagggagagaagtaactagtggtgcacctgcccttacggtgactgtgctcgactgaaggaagtgtgcattacataaggacagaaattagagccgtgagaattcatgtgtcatagtttggcctagatagaaaagtcagtgaattctgttgagagaatgtgattctgagctgaaaatgaaaggataagttaactccgtgagtggaagagagaagcagattttctaagcccccagcaacatttgcaaatctccttggacagcagagagtagggcgagtacaggagctggatgaacagcctaggggcacgaatctggaaccagagatgctggaaatcagaagaggccagaaaggtggcactgggagaagcatgcacatcagcatctggattgtgtagaaatcagagactggcagaccagaagtgatgacagcctgggccagggtgaaggggaagggtaggaggactggataaactgaatgttatttaggaggctgcatctccagaaattggtgatagatatggtgcagaggcgtgcggaaggaggttcgtcaagggttgctccaacatttctgccatgaaagttgacaaatggtgtagctattcatggagcctaaggacataggaggtggatgagttgcatatactgattcaaagtgcgaaagaaggtgacactggcaggtgaagctcgaagggaggttggagatagaggcacccaacccgtgtcttcatacccctgtcactttgggacttgaatgtggtgaggtatgtctttaagaaaactagagtgtgaagaagacacaaaagccaggcatgggaaggtggaaggtgagtctgcagtggaagcagaaggaactaccagagatggaggaggaaatgcaaaaacgtcgtattttgaggaagagagaagagaatagattaaagcaacagacatcctacttagactaaaaataagacccatttatttaacaactatttcttaaaggcctactgtgaacaagactctggtgatgggtaaactctagggacagagcagctgaaaggcttgtccccaggtatgtctgacaccagagaaaaagctatctgcaagacctgcttatttgttacactgtgtgaggccctctatattctgtgcttgtatcctcttggaagatgaagttatagtgcattctagctttttcttttcccacaagaaaaaggtccagtgagatatgattagaaatttttaactatacacattttaatgagagttgttcaagacatggtcatcttatatttttgcaaaactacagacaaaaccctatatgttatgtaaccacaggtaacttctagaagaaaaaatattgactttcagtgtccagatcaccatgacaagaaagagtgatatagatacgctcatttgcttcttattttgtgagacaatgagatctaacatattgggatttcttctctttaattgactatggacatgcgtatctacatttaattctcaattacctaaaatacttcctgggagaagtatgtttatatccttccaaataattcctcagtatatttcatctttattttgagtggctcactttttgttagtgtatgccacttcaattttaaaggtaagaatttatgttatcaataatgttatgttttgcttataatgcatggatggcaataccttacaatttcaaccaaaacttctctgaagtatttgcttcaaatgatgtttcttccgataggacatatacccacacatataaatgcagttgagagaaaggttttagctcaatttgcctattgatacgtgtataaccaaattaccatttcagatttatgtaacagatcacacttaaatcacaggatagggctacattttaaatgatcaagctgtccccaaaggagtcgattgtgtttagcataaaactctcacttttctatttttaagtagatatcattaccgtaatattaaaaataattttataactgtaatctcagaataaaattcattatctctaaatctaatcttattaaacgataaataatgtatctagctgttatgttaaaacttagacaaataaaccacactgtcatttctgtcctgccacaacttttgattaatagaaaatataaatatttattatgcagttttcatttcacttccccccgcttccaacgatgaactaaatttacatgaaagtcagagaggttttcaaggactatataataaaatctattccatttcgtttttctcagtctttcctgtctgtataatttgacaattttcataaaaatttttcataaaaaaaatttcattccagacactgtcgttattagccattcaaagaactaggatatgatttgtgagccatgctcacccttggatttaaaagaacagaggcataaagacctgttttattgtccttctgtaatgggagtgagcaggcaagcatttggattttggtcggctctcacttacactttctacacccatgcggtccttctgtgaccatcacccagtcactgtgtggcctgaattgctagtacttgactgcaaaaaaatggcaggtgtgacacagaaattgcaacaaataattataaatctaatggaccctgtcaaagatgacaggtgtcttggaaaaatacaaaatgaacattttatttttggcctaaaacgggcaagtcatctaagcaccccgatgctctccgttcatgtgtgcgttttaatcattccatttgcaatatagcaatgcacgctgggcattcctccctcaaatatcagaaggcagaggatatacacatatatatgggcaatatttatttacttattcgtttgcttcatttaaccaataatccatttctaaatatttccaactaataaaaccaaattttctttaattttcttgttttataaactgaagtctgtttttccagtacagagctaaaagaaagtagcccgggataatttaaaactaagcatattataaaaattagacttatgtttagaatctaatgtccccacttaacaaagccacgccttgctctggtttacgatgtaatgtagagactacaaaatctagattgcctttctcttcttagcattatacaaaaacttatttaagtctctgtctcttctgtatcatctactggcatataacttgaattcttaaaataacataatgcagtaacagttgatgagtagaatttattcttcaatacgcagatagaatgtatttaagtaatatgtaaaaaaaagttgtgctggcttaagatactgtataaataatatcatattattggacattaacgtaatgacaaataatgagttttgaattgtattggtcactaagaatttataaaacggagtaacaaattgcaatctattaaacactagcacatagtttaattttgtcaccgaataggatatgagaggttatagccagggtctacagcaacccaaaccactccttaaagatattcccatcagcaagtggaaaagagtcacttgttttcttggtaagtcatatttgttgtaacttttttcctgttgaatggattgaattggtaccccactcgcccatggcctatagaaacaatatatattggcatacttggtaaaactctattttattttttccgtttttttcttacctaaatgaacacttaaatttttggttgatacgatgaaaggattttgacacagtagaaacaaaacagacgtgttgtgagttttattctacctcccctgacattgcacagcttcctcttctgcactcgggagataataacgtgcacctgccttgctcataaattcatttaaataaaatacccaaagtcaagcctgaaattgtaggcactcaggaaaggccggtcatgattttactcctgagttttaaaacattgataaaactgtcatgggaaaagagaagtcagtgtaaaaaacgagacacatcacaaaaatgaaagaaatgtaaatggagagcccttccttgggtttgcccagggagacaggcgggtaggaagaataaaggagcccaagatactgttactttttcctgccttggacagtgttcccggcagctgctgcaaccctccgtggctccggctctcactggatagccctgcacttccccccgccctaccccgctggagccctgaaactacctccttcccttattccttcaatcttgcttagaatcggaggactcctcaccatcatcacaagcttgaagtcttggatcttccagcacgtatgcaatccttcccccggaaaaaatttccaatatttaaatacttgcagtggtttctgtttttccactgggactcagaatggataatttatgaacatggttaaatattaaatcagtatgtgtaaggttaggtgaaggaagtatctgaagacatgaagcaaagagcagagagagtgacaacataagataaaaattttagagacagagtttcagtttgagagtttcaacattttcctggtagatgctccataacaaaagaattgagaaaacatcagtaaataatcgaagcgagtaaataattttgaaaatgcaaaagcaatgctccctgtgttaagctcaaatatgcagattaaagtgtgaattaaatattgaaaagcatgaatgtaaagagacccataattagcgatatgctagggaaaagcatatagagacggactggatcaaggtgacctgcaaagttgaaagaaccagactgacaagacacttcacaaaagccatgctgaatatgaaagacaaaggaaacaatctttcaaatgtttaaaaaaatatttatgctactaaaagtagcattgatttcagaaggcagaaaaaaattttcagacagaggaaggcctctaaatagtgcaaaccacacattgaactacaaagaattgtagaatcattacaaatatctcaatcagaaaatggttaggggaggatggcaagaatttaaacattgaaaattaggtctgaaaatggagggatgatgtcaaaaaaataattggtaacaattctgaaccaaaattcaacgtatttacaacaggggaagtaacaaaaggcaagtgaaaggaagataaataatatcgtggtaaagttctcaatattttaggggatttaggagcagctgtacagcttattgattttaaatttactttggtaaagtttaatatctttggttaattactagaaaaatagaggctttgtaggtttgaagactgaggagaaaaaaaaaaatcagggaaggtgaaggtggatagcaatttggaaaaaggagcctcatcagaccaaccacaacatcagagtaggaaagtcatatcataaaaagaagcccccgaataactataatcaatacctttgaatcagcaaaatttctttatcagtaaaaacactccttgacttttaaaatttgtataaaaagactgtgaattaagaaagaaaacatgtactagacaaatgccaatgataaagcagaataacaatgttgatatcacagaaaatgaaatttactcaggctttgcatgggaaaaagagggatgtgtttggtgcatcatactgagctaaacatgctgttacacttacattactccagaaactgaaatattggagagaaacaaagacaactaagtcatacggacttaccattttcataatcgtaacacacctgagtcagaaattgttcatctctgaacgtgattcaggttgtcttagttgtacatggttagcttagttttttgttattattgaaccttctacaaatagttattattttttgtacagaagcgaatgtaaatcaaatgtatttttgagtgaaaactctttaataaccagttcctgagagtgaaacatatttactcatgtttaatgtacagaaacaaaacagatattcttatcaatgaaaaaactcaggtcaagagaagtgaagttacttgccgaaggcagtagatcagaaaagtggaagctgagccctgaacctcagccatttgattcctggccttatgtttcaaagtgtccttccttgaaaatgtgcatttttggcaaggattcatgaacaataacatataaagtcacacagagaaccttaataaaaattcaaaagcaaattggcacagatcaagttgtccgttcatgaggaaataaaattaaaagtcagaagattttatacatgtgcacacaaacacacttggtccccctcggtcctcctcagacacacacacacacacacacacacagtctttcagataacttgacttaaatcaagaatgaaacacattaaaatccctttgcagatatttgcagataaatgataatgggtggatagaatattatttcattcacaatattgccaatgtagcttttttttttttttttcttttttgagatgagttctcgctgttgtccccaggctggaatgcgatggtgcgatctcggctcactgcaacctctgcctcccgggttcaagtgattctcctgcctcagcctcccaagcagctcttaaagcaaaatacataacctgaaatgggcagagaaagagtgaaagagagaatatgaaagtaaattatctaagtgtttttaagaatctacaagcagtgaattagtagaaaattaaataaaaaatgaaaaatgtatataaattcaataaatttgaaaaagcaaaacaaaagacttgataggtaaaagatcaaagcttattcttcaaattctgaaataaatggatgaagtttgggcatatctgataagacatatagaaagagctaataacataaaaactgttcactgttaaaatagagataatttttcaaatgtatgggatacagtgcgcaggcctatatgaagacttttggtaagctagttaaaattcattattctctaggaaaatacaacttaaacaaaataaatcaaagagaaaatccaaaggtatctatacataacagatgttgaaatccttcttgaaaatctgtacctaaaaaaaagacaaaaagctttacaacatttaaaccaacattttgcgaaaaagacattgccccgcccccttggttaaatagatttttttctgtttttggggaaaaaaggggtaagaacaactgtatgctactcaccgttccagatatcaacatatgctaaaaagacattggaatctgaacaatgtgacattggctctgaaagcagcacatagattaatgaaacaaagcaagtagtccagaagaagacttttatgtaaatgtgagtttagactatggtacaggtgacagtttgaaccagttaggaaaaagaagttcggcttctcataaaatgtattggcaaattagcatatcttattgcagaaaatgtaatttatgtaaatacatcacacatttacaaaagaattgtcatctgggtttgaggaaaacataaaattattattcaaagtgggtaaattaaaatgtgcatttttataatacattaattgggaagctcttaaagacaacaaataaaccctgaagacataaagaaaaacatttaactacatctttgtgaatataaacattaagaaaaaaaattctgtattaataaaagcatggtaaacaaagttaaaaaagtgacagaaaaatactaaacaacataaaataatggattactctacagaatatataaggagcttctagttcaagaaaaacatcagttagaaacattggaaaaatattaagtaggcaattaaaagaagaaattcagataccaatacaactattttagtgagttaataaagctgatgaaaatcacagaaaagcaaattaaaacaacaaaaaggtattatgtttacctgtcacactgacaaaaactagaaagagagataatatccagtgacgagccctggaggggataatcgacacagccctcattcctggaagtcagtttgacattgaccatgcaaattacaaacacagatgcagtatcacaccgtgcaagcgtattccttggaaatctttcacaatatgctcatattaatgcaccatgtggcatataaaatatattcacttcattaatactttataaagccaaagggaaaacagtctaatgcctcttagtaagaatattgttaaataaattaaggtgtgtttatactatggagtagcatacagaagttcccatctacaaggtagatttataccctattattattatataatacaaagaataaaaatgagatgcaaatcagaaagcaaaagtgttaaaagcaatatatcagtaaatgtacaaaaagactatatgaatgcatagaaaacataagtctgaagaagaaaacactcaaaagttaagtgttcacgtctaaggaaagactacttttacttttttctgtatatatttctgtatgattttttaaatataattaggcaatacctaacgctagtacaagtaatattacccttattagcccaggtgtctttgcaaatatttactatatttttcagttagtaaaacgtgattaaaagacatgaacctatttttttataatctctatttgcagtagagggacacaggacgcagggctgtaagctcaggattctcaactcccccttgctcttgttcacaccatttttcttgctgtggagatggcttcgtcacctaagtatcaaccatctgagtatgtgattgacttccttttaaaataaagggacacctggctacccaggtggtattaccattttagaagagcactattttattggcaatgtattttaaggcctgaaagaatcttgaaaagttgtttcaattatgccttaatgaaactactttgttcaaattgcaggtgacaaatgggaaaaaaaatttccctgtgacagagaggaagaaaatagcaagttctatttcttcctacctcccgcaccttctactgactcagaatgtttatttctacatctggtggtgttagtggtgctctcattacagtgtttaagagctattttggtcttacctcttttggaatttatgtctgtaaaggccatcttcttttttcttttattgttgataacctaccatctgtttgtttgctaaaatagaatctaatacagtgaatgtcaacttttacaatcaatggataatacaaggtgtatagtctacacaaataatgtaaatgcatttaattaagttagactacatgggttgctaaataattgcttgactgaaataactagggagttttgggaaataattaattcagtattttatttgaaaactctttaaagtggttttgtatgcattaatataagcccttaggataaatacatagtgtttccaatttcaataaatttggattcagcatctttcagcaaaacatccgattatgtgcttaagacatttcctaaaagagatgaaaaataaattgcaagatgctaggaatttcaaggcaaactccctataaaaatatttttagtataaaacactattgtctaattcttttaattacagacctttcaaattaagaaaaacattgtaaacttaaattaggttcacacacagtagcatgtatcagaggaatgaaagctcaatgtaccaacctgatcaagggtcaagttattcaatgaataaaatgctctctaattcacttcaataaacttcagtctttcaagtaaggttacattgttagcttagtgtcttcacttgtaagagtattcttgttttacctaaggatgtagagataggtacaattatttgcacatagaattttacctcttcatagtgagatgtgactgtcacatgtttcacttccagatgtattttcagaaatctcattgactcaaaacacagagttcataccgtggcatcagcctctgctctcaggaaggctttgctagttccaaagctggaaaatggcccattattctattaactattaatttgggcatgtaatgaatggaaccatttccacatatctatttatttggagaggtcttgattgaaaacatgtgttcttactatgaaatcaaacaccaccaatactttcccttggattctctgcctttgcgtttccccaggtgcaccactccctccttgtgagctctaggggtttggctgaaatcatgtttcttgtcactcaatgtgatctgtgactaaagcaaacacacatcttaatgtcgacaaaagcgtccttaaccggaatgtattaggtcggtgcaaaagtgattgcgctttcttccatgactttcaattgcaaacaccgcaattacttttgcagcgacctaataacatgcagaacaaaaccaaagcaggggagggtgtcggagtcacacgctctcatctgtcctgcccaggatgcccatggctgtgaggacctgaagcaggggagggtgtcagagtcacgctctcacctgtcctgcccaggatgcccatgactgtgaggacctgaaggagaggagggtgtcagagtcacgctctcacctgtcctgcccaggatacccatggctgtgaggacctgaagcagaagagggtgtcagagtcacgttctcacctgtcctgcgggagggtgtcggagtcacgctctcacctgtcttgcccaggatgcccatggctgtgaggacccgagtgccatctcccctgtatgtgccttcctactctaatccataggaacctggaggttctctctccttttcagcttacttcgtagacatttgcatttctcgtttctcaccaaattcactccactctatcgtgctgcttcagtcttcttccagcctgagccaagatcaagtgtgtttatgagatattgactaaaatgactagaaattatttctttaaaacaaaattaaggggaaaatgggatttttctagaggccatcataaaatagttttctttcttagaactagtttctgacgtataaactgattgaacatagttttagcacctttacctttcacctcaagaacctcaggaaatattaattattaggtaagatacctgaagtcatatatttctgtttcatagttgtgatgtagttgaaaggtcatacattctggctgtaaagaggaccacattccaaaactggctctgtgaactggacaaattgctatacattttgattctctgtttcatcatcaataaatacaaagtaactccagcaattctagtggctgtggtttgcacatcaagtttcaacatagtaggccctcactattagtgttctaggaagaatacataaaatataatgtgtcaaaaatagccaaggacctattaaggtaaattttctttgcttttaattacctttacttactgtttttctctccagctttaaataaaaccttatatttgcagtctcttatggctaccagtaaccttaagccagtcattatggttttttttctatttttttgacatttcacacttatagacagtttaaaaataacaagaattgttgtctacctttcatacaacttcctgtaatgataaacatatcacaaggatataagcaaggaaaataatgttaataaaaaatggcctcacctacaaagcttattcaaattttggctacttttcccagccaggattcaggcttactcactgcatttggtggtttctcagtcttccttatctttcaagaggttgacacatttgtagaaaacttgattcataaaattctcctcaatttgagtttctctaatgtttcctcatgattcaatttaggctatggatttttggcaataatagaactaattttgtgttttcagagtcattcctactgataccagctttgacacttggttggggcatgtctgtcagtattctccaccttaaagtaacttgttctttttgtgattaatgaaaatactgtgagtgatactttcggacattgcacatattccgtttctcatcaaacgttcattcactgggcttaccacatattcatccttcttgcctgaaacaataaatgccatcgtgtttgccaaatggtgatttttctatttccatcatttctttgatgcttggaaattggaattatattgtaagtaaagattttcccttctcctcattcattaactcatttaattattaatttgtgtgaatgtatgggttacaaatctttgctattatttcactctctttgttgctgaaaatctcccagatgcctattggaagtctcttcaagttggcctttgtgaccttttgatatgtcctgtgatttttggaaatgttcttactttttagccctaacacatatcccaggcttggcctgcactttccctgcaccggccatggaatgagtcattacctcaaggacccctggtttcttttgttggcaaatgatatttatggtgaagatctgtttaccaatttgctttttggtgttgggatgtcactgccgtagtccttcttagcagatagagttagggtacaggggtccatagactctcacataaacacacacatacctctctctctctctctctctctctcatctatcagtctatccttctgtatgtgtgctcacacacctatacgtgcaaaacaatatatatgtatatcatatgttgtgtgacagttttgaatgaaagaatgggaaataagaaaatatacatatatctcctcattttttaaaaaaggaaatgtaaaaataataaatcaataactaatgataatggttacctccaggggcttgatgtgaggagagggtgtgtatttaacaacatatcttgaaaattactccttatcgattcctaaatatagctttattttctttctattttttctttcttttattatacttcatgaatacaatatggatgtaccaatgtatcaatttattcatatactcttttatatatggcatttagattatttctaatattttataattaagagtgtacatatgtatttttacattgttgaaagtttatcttcagagtaaattcctagaagtggcatatatgggtcaaaaaaggaagggaaagagagagaggcatgtaagcctatattgttagactggattttaaaaatgagatttaaccatatattgactacatgagactcactttagataaaaaatacgtgtatgttcaagtaaaagaatgaaaactaacgcattatgcaaatatcagtcatgcaaaagctggagtggctgtacgaacactgctcaaaaaagactttaaaacaaaaagtgtcactagaaacgaagtgagacatttaaaaaaaatgataaaattgtcaactcatcaggaaaatataacaaatgtaaatatatatgcacctaccaacaaagcaaataaagcaaataaataaataaataaagcaaatataaataaagcaaaaccagtagaattaataaatattgaaaataaagcaaaaccaatagaattaaaaagcagaaatagattaaaataatggttggtgacttcaatatcccactttcgttaacaaataaaaaactatgtaaaaaataacaaggaactagaagaattgaatagcatcatgaattatctacacgtaacaaaaacgtttgtaaaagtagccaagtgaaaaaaatctaatatacctcggttctcatttgcagatgaactgttgtccatgataactgtatttacgtcataaaataagccttaatacatttaaacggattgaaatcctacaaaatatgttctttaacacattgtaattgagttaaaagcctctagtagaaactaggaaaagtctacatgtatggaaattaaacagcatacaactaaataaatcatgaggcaaaataatcacaatgtaaattataaaatactttgcggtaaaggcatataatgactgaacatatcagatcttatggaatgcaggtaaaactgggcttagatgaatatttatagctgtaaatgtttatatataaaagaagaaaaatctccaattaatatcctaaacttccacctagcacattggaaatggattatcaacattaacacaaaccaagcaagaggaaggaaatatataagagttgagcagaaaatgatgaaatacagaatagaaaacacagaaaatgagtgaaatcaaaagttggttatgtaacatcgactaaatatttttaaaaagtcttaaatagactttccaattaaagcaaaaagaaaagttacttaaatctgaaatgacagaagagatcatttaacaattttacagaaataaaaatattttaagaataaatttatgccaacaaatctggtaaaataaatttttttagaagtcctagaaagaagacaccgagtaccaaaagtgactcaagaagaaatagaaaatctgaatgaatctgtgatatgtactgtgattacttggaaataaaaatatctactcacaatggaaaccccaggcatcacagttttactgctgaattatatgaaacaattaaagaagacctaatgtaaatatatccacactttcaaaaaataaaagagaaggaaacactttccaactcattttacaaggtcagtagaaatttgatgccaataaactaaaaagacatcataaagaaatccacagaccaatatcttttatgaatatagatgcaaatttcctcaacaaaacattatcaagaaaaatccagcatcataataatgtattaaggaatatacatttataatatacataaaataaaaaaatatatatagtgctggaacaactagatattcaaatgcaaagtgacaaagttgaagctcaaaacggatcagaaattccagcattttgagaggccgaggcagtggtttgcttgaggtcaggagtttgagaccagcctggccaacatggtgaaacctgatctttactaaaaatacaaaaattagctgggagtcgtggcatgtgcctgtggtctcagctactcaggaggctgaggcaggaggatcgtctgaacctgggagacggaggttgcagtgatccaagattgcaccactgcagtccagcctggacaacagagggagacactgtctcaaataagtaaataaataagtaaataagtaaataaaaaggatcagagacctaaatgtaagagctaaaatgataaaatccttacaaagaaaacacaggcataaatctttgtcagcatggagaaagcagtgttgatttttttgttttgttttcagataagagcaaaaacacaagcaacaaataatacatatataaattggatttcctcagaactcaaaactttgcacatgaaaggaaaccatcaggaaagtgaaaatattgtttcatttttatttactatatattataatacataagtatatctttattatatctctaatattaaaaatagttttatatttaatgaagaaagaaaggttgattcaacacctgaaaatctattaatgtgatatactatatcaacaggataaaggacaaaagccacctaatcatctcagtaatgcagaaaaagcatttgacaaaatccaacacctcctcataataaaatcaacaaacaagaattacagtggtgtttctcaacttgataaaggacatttatgaaaattgcacatgtaagattatacttaatgttaaaagactaaacgctttccccctaagatcaggaacaagacatcgatgtgcctttttggtacttctgttcaacattgtgctagaggttttagaaagcatattaggcaagaaaatgaaagacaaggcatccagaataataaaaaaaagaaggaaaactatctctcatttctgatggtacactcttggacatggaaaatgctaagaaattcgattaaaaaactattatatctaaaaataaaatttagcaggcttgcaggttaccagataaagtagacaaatcaattgtaattctatatacttgaaatgagactctgcaaataaaattaagaataccattccatttacagtagcttctaaaagaatgcaataatacttttaacaaagaagttcaaatttatactctgaaaacaaaatattgtttaaaagaattaaagaagacctaaataaataggatgaaatactgaatttctgtgttgggagatttcatattgctacagcaatcttcagttaagctgaagcttcaatgcaatacctatatctatgttgcaaaaattgataagctgaccctaaaatttatgttgaaattcaagagaaccccaaatacccaaggtagtcttgaaaagggggaataaagttagagaactcatgcttcccaaatcttattccaaagctaccgcaataagacagagttgcagtgacttaaggatagacctattgatccaaggaaggaaactgagagtccaaaaataaacccttatttttctgggcaattgttatttgatatgactgccaagacaattcaaataaagtaatagacttttcaacaaatatgctagaacaactagatattcaaatgcaaagtgatgaagtcgaagcccaatccatctcaatatacaaaaattaactcaaaaaggacctaaatgaaagagctaaaattataaaatccttacaaagaaaacacaggcatgaatctctacaggcatgtagaaagcaattttgttttcagataaaagcaaaagcacaagcaacaacaacaaaaaatacatatagatattggacttcatcaaaactctaaacgttgtacctcaaaggaaatcatcaggaaaacacaaagataacccacagaatgggagataaattgggcgaatcatctatctggtaagatacttgtaactagaaaaaataacatgtatatataaacataggtatgtgtgtgtgtacacacacacacacacacgaagttcttacagctcaataataaaaaggcaaccaaattttttaaaagaagcaaaaggtgtgaatagacattgatcccagtaaagtagacagatcaccttctggaaatttgttcaatatcatttgccatcagggaaatgcaaatccaaccatagtgagacaccatttgacattcactacgaaggctattatcaaaaatacagacaatagcaagtattgtagaggattggaagaaattggaaggctcgtaggcagctagtggaaatgtgaaatattgcaatctctttggaaaacagtctggcagttcctcaaaatgttagacataaagttaccatatgacccagaaatttcacccccagttataaatctaagagaaattaaaataaatgctcacaaaaaaatattttttgtgtacatgaatgttcatagcagcattgttgataataaccaaaatgtgaaaaaataacaaatgcccatcaaccaaagaataaatacacaaaatatggtatggccatacaattggttattattccgcaataaaaagcataaagtactaatacatgctacaatatgaattaaccttgacagattatactaagtgaaagaagccagccacaaaatattatgtgattctattatacgaaatgcttggaattggcaaatgtctagatttggaaaatatggtagtggttgtcaacatctggttgatgaggagaaaataaattgactgctaatggtcatgggtatttctttttgggatgataaaaatgttcaaaatgagagagtggtgatgatcttgcatttcaatatactgaaaaccactgaaacgtattatttaaaatggtaaattttatgatatgtaaattatatctgataattatatccaaatagaggtattatatacatttatctgtaactctatttatcttgtatctatattagctttcatcattctcttatctgatccttgttagaaatcaaccatgttgctctggtagacgtcatgttctgctagcattctacagcattcttgcacaagagaaaatgacgatgccccattgcgatattgaattcttaaatttcctttccaccttactataaaatcttgtagaggactccagattttctctgctagtgctcttaagtaatccatagcactctaacgatgttattggtgctttgtggaaaggagctctcagctaattgtcaattttctcttctgtcttggcagtttttaggtttagtttggagctaacactgctagctccctcttgatggttttcttcacttaatctagtgaagaaatctaggacttgctctcattcctttgctttcttccttcaaagtcttaatcccaatattcaagtcaaaggaaagtagaaagttttcctcagtttgttactgaaaaaggaggaagtgttcagtgtaaggcattctgttttttttaaaagataattattataatattataacatattataaaggtgttttagtctggttcccagaggaaataaacggcacatcaaatggaataatttgaagagtctacaacgttgtacacagagcatgggaaacccggtggatagttgaatacctcattgcatctttctctatgcttggggttgaatgttcttagggaaagtggggttgcctcagcagaggccacggacagaaaccattacctgtgggagaggaagccttcctttgaaaacaggaagaagctaaagcaacaaaacgccaaactcgccccccaatactcttcaaattccctccggaatttgaagctaaagccacacaatgccaaactcgctccccaatactcttcaatttccctccggtactccccattgcccaagcaaaccaagcaggcgacatgtcaggagaggtcgtttgtctgccgtatgccattcagccacgtgagttagagaggtgggaggagaaggggcgacatccaccctcagggcacgtagaggatgctggtcccagtgtgtgggaaatccaccacgcagtgtacaccaccgtctagtgccaaggagactgggatttccagcacttgtaactacatgtgcttcatcagcctactctagtttattttacaaaatactgtggttaaatgagggcttattattcgtactttctaaataagaaaacagaaattcagtgagattacttgcccaggattgcaaataagtgttggaagggctgagatttctttccaggtatagctgagccccatgtcatatccttttcattgcatgaagctgattctccctgcaagaagaaccccacaaaagtgtccagcatcaatgtttttcccctgcctcataaaagtgttgaaaaataacaaaacaaaataatgctcgaattgtagaatcttggcttttacttataggcccaaatcatcttattccatgcagtttgtgaataaaatgctgtacaatgtcaacagtgtggtctctaaagaaaaagaccactgctgcatgctttttattcaaaatatcaagtggaagggctgaggttgcagaataccttaaagactctttatgtatttaaaactttgcatagttttttatttccaaatttaagaaatcaattaaacatgaatttattgaataaatttgagcttgtaaaatatattgaggcgtaaatgagataaaaaaaaaaaaaaaaaactaacttcgagtttctgacctggaagagcctaattctataggcaagggtttattgcatgtagggagacaagatagatagatagatagatagatagatagatagatagatagatagatagatatgtatactaggtatatttgttcaactatatccatttaattgctcacaaaatagttactgtgtaaccatagtatattagttattatgtattcaaataaaaaaatgcattgtcactatccttgtagagggcacagtctggcaatgaagtcacagagagaccacatattgataactcagtgagaagtactagaatggacctatgtataatttatttttcacatagcacacaaaggaaactgctaaatctagaaactcaaagtgaaatatgattaaatcaagattataattgccagtgatactattaataggggaagaacaatgtgggctggagtagctggcagagtcctctaggaaaagagttgggaactgagccctgaaaaatgggaggatttggataggtgggaaaggaaaggaaaggcctcattactggtttcagaaatagtgagaacatggattcctggcccattctgggtgtttgctaagtccaaagatagtaaataaggaatgtaacatttcttaaattctctttctataaagcatgaataatactaaatagcttagatcagggacctttcatgacaagaatgacaacaaaagtgaaaactttttctgagtgcaggaagaaaatgcacaaagaaatgagtatattgaaggcaaaagattgttccaactcatcttatcatggacacgtgggatatttatgattatgcgatgggcagaacaggcacggcagaaaagtctctctgtctccacttccgattgcttcatcgggacgcttcgaactgagtaaatctcaaatccaatagaggcaatgtgggctttgagaacacaggaagtgtgtctatgtagtaaagaggatttcagaggaggaggcgaaggaaaaggtgacatttaaagggagtggttctgtatgacagaattcatgggctacacaacagcacaggaaattcctctcttctcagacatcaccgagtcatcatacatctgtaaggagtcctacgatactctgatgccttctcttttggaggcaaacaagtggtttgtgtgttcagacgtcaagtaaatttgactatcttagctgcagcctatgagtttgcagtggaatcaaggtggtgtgtgagatccccaaagctaacttcattttttttctccatcctttggggaacaggtcactgaatgcgtatctccgaaaaatgatagcagtgtgttcttcccttaactctctcctgaaagagaaattcagccacatgtctgggaaacatatcacaatatcttccagcagaaagtggcagagtttcttagaccgaaataataagattacaacggccaaaactaataagttcagcagaaaggtaggagattacttttaaagccaaaaatacttttaaagccagaaataaatcagccaatggatgattcagatataatattgcttttacaacaaagggaatgaacctcaacaacaacgacaaaatgaattctggttgggaagttaatgagataaaatccagacttgtaagaacatcctgactgatttgattgatcgattttatttgccaaataaaaattgcatatttttatcttacacaacatgatgttttgagagatgcatacatggttaaatgcattcatctgtcccctgtcacttgagatttccggttctataacattatgaaagtcccaatccctttctaatagcactttttttcgcagtgctccacctctcccgattctcctgctttctatgggccagtttatctcagactttcctattctggctctttaactgttgttgattctgtaactacagtctccttattttcttcttcgttttataaaaatctccctagaaatcgtattcattttcttgtaaagaaataccaattatgtatttctgtcccttataaacagcagatgttataaattcatatttgctatttcaaagtagctcctaaaatatcttcccgatcccctaaacttcctcctaattcttcttcatatcaattcattgcactaagttcagccagttactcatgccatttattcataaccatttctcccatctcactttcctaacttcctaatcctatatttccaagtcctgctaaatatagccaataaacacaaattgaaactatctcccctattccatttccgcaacctttcctcgagttgatgtccttgtccctgttcatgaaacgctgcagccattggcctgtctctctgtgcctgcctattctccttcctttattatattttttaaagctgccaccatattttgtttgctcaatacgtaaatgatatctttttttgtttgtttgcaaagcttacttagtgtctacaatatcaagtcttactaccttaacccttgaaatcttttctcaaaccccaaatatcctgtcccttgccctcacccatcctgttctcccatgacccctctccctgcttctcactgtgccttggcaggtcctcttcaccttgtcgtcctcttcaccttgtcgttctctctgctcggagcatcatcagctttttgtgtgtctgggttctgccttatcctgcaagtctcggtgacatattaaaaatttctcctctgtactgtttttcagcttcatagaggagggataaactcaaactataatcttaaaacccacaaatttactgtgaatgttttctacacaaaagatactgctgggtgccatttcaactgtaaaaatgggtaaaatacagaatataagaccctacacatttcacaagtaatgaaatttcctttgaaattttgagagagcataatttccagcacctctactaactggtgatagaaattatgctctctttttgtgtcttgtattctattgacttttgggggttgtacaagaaataatcattctgaataataataaaaatcatcatcatcatcatcatcatgattctatgctgtcttacctctacctaccttcctccaaaaaacccacaaggacatttttaatcatatattactaatactttctacaaaatgaaagctatatttaatggtatagtttaggcttccatcaaatgacacaacttatgtgtacattttcccgagttctgcagaaagatgagttctaattgcctcgcgttgtgttaagttggtcaagaaagcaccattaatttacttttttcctttccttccctgaccctttcttttcttttctcaccttatcttttcttgtgagtgattttaagaaccacctccaaaacaaactgctcattctaaaataattttcttagactccacttctgaggaaagccaaaacagaacacgctgagggttactggtcacatactcagacaatggcatcattttacagagattcttaagctcagatcaaataggttttatgtggtgatgggatgctgacaggtcctatttctgaacagggtcatgggtgtgcacatacatatgtgtttggattatagtgtgtctctgtttgggtaggtccctttcccattgtacatgatggaaatttccttctcaatgatgttccttgatgctacactgggtagagcaatttgttgtttaaatattttcacttgaaggcaaagaagacgggcctgttagtgaaaagatttgagtcaccaaatctctaggactgtactttttacaggcatgaatacatcctttgaaagtgcaaacacatagtctgtcttcctctttaaagataatatggaaataattccagatggaataggggagatagtttcaatttgtgtttattggctatatttggcaggacttggaaatataggattaggaaattaggaaagtgagatgggagaaatggttatgagtaaatggcatgggtaactggctgaacttagtgcaatgcattgatatgaagaagaactaggaggaagtttaggggatcgggaagagattttaggagctactttgaaatagcaaatatgactttataacatctggtgtttataagggacagaaatacataattgatatttctttacaatggaattattactccttttttctgtagttctttatgataaacagaaatgtaaaataacataatttatcttaaccctgattaatgtaaaatttttaaatgcagccaatcttatatttcctgtaatagtcaaaatactggctacaaattgggatcttcttatgtacatctgtttagatttatgctcctgttttattcagctacattgcatactcattcaggggccattgtcaaaagacacatcttcaagtgtaaaatgtgtcatgaaaaagagcatgataaaaagaaaaacttaaatctttataaatggaattcaataagtagtgtatttgaaagaaataactgttaaaattaatctccacataaggaggatgccttttatttttctttctgagaaactcttttatctttgtattatacttattgtatatatttttaattgtcataaaattacataatgtgtaataatttttgtgtgcatggattaggagaaagctaatctccttgaatcaatgtgttctttgcctttttgctcattcttacctacaatgttgtgaaaatcttcttgatcttaacttctattacttgaactaatttagatctgagaaggaaaaataaaacacccccaaaaaactgagaaatgactccagatgtaaactggtacactcagcacacaagaaagaggtcatgatattgtcttagaaattagcacagaaggagactatatgcacctaacggcacttaaaacacaacacattgcattgtgcttttcctaaataacctattgtgaactgatgtgctaagtttacaaaaaaaggctatattatgaataagcatccttgtacggtgaaaattgagaaagcattgaaatgtgctgatttgcttaaatgtttacacatagtcttgttaaaagcaatctaattccaataactaagtgtacaatttttaaaattgttcttagtatgtatgaagtaaagatctttacaaaaacaggccacttgtactcctttaacggtttgctctgtatttcagagaggtatgcattttttcacaattgtttgttacctgtagattttaagttaattctgttgcccatgaataccactctcctttaaagaagcaatgattgcagcatatgaattgtcatggagggtaatattataccacagtagcagattactgaaagactgagctccaaaagtggcctacatatttaggtaaatttatgttattacccagcagggaaatagactaagcagtcatttgtattccttaattttaccattgttcaaaccaagctgaacttactgtacttttttgttatactcattaggctatctgctagttttctgaagaattgaattgataggttttttccccttactaaaattctaactttttactctttactataaaaataaaaatcgtgttcataagaaaatgtgaaaaatagcatctcttattaatgaagaaaattctttaaattgttgctattaaagactcttttgagtaattaaatattcactaaatggctttcataaattatttcagattatactagtgtttgtgtgtgtgtgtgtgtgtctgtctctgtgtgttcatttttatatacaaaccattatatcttagagttccctatcctctgaatttaaggttgcttgtttgagcatacctatatacatatttgttagtatttatcttggtttctcagctctacttaggtttataactgattacttttctcagatttgttgtaatttctcttctttttccaatcatatcctattgcaaacaactcaagctacgcttagagggcaaaaccagcttcgaatcatggtgacaagatctatgcttctgcttgagttggacagtagatggcgctagacaaatgccaaagcttcatctcatggagttgctcaagtgagacgctttgcatccaaacatgtaaaatggcttttagctttaattcatatttaggatagaactccctcccctgtttaacaatttattctggagaaataaaggcttgatagaagaaaacaagtcacttttcagttccaaaatattcaataaccgtcgcatgttattacaaggtcatatcatattttcgaactgagaatcagtgagcttgtatattaccagaggacttgggtatagcgcttgttcatatataattctcatgcttattttccttctcagcttttaaagtactactgtacagagaaagagacacgaatctttcaagatttgtaggcagagcacatactaccttaccatgagggaaggagggcttctgtatttactctgaattccaaataccaggaaagattttcttacaaaaaaagaaaggaagaaagaaagaaagacagagagggagagagaagaggaagggagaaaaggaagaaaagaagggaagggaagggaaagaaggaaataaaggagaaaaaagcaaaagataaaaatgaaatgaaaaataaagcttgtggaaatatctaatatagtatatactatatatacactatactctatactatatatacactatactatatttaatattatatatatataaaccagaattaagtgtgtgtgtaaatatatatatatacacacacaaaaagtctatctctatttctttctgtctatatgaaatatccatctatataacttaaggtgttaagaattcagatataattcaaaaataagtaaattcactgttagctattctacataagatgccaactgatcccaggactctgggaggccaaggtgggtagatcacctgaggtcaggagttcgagaccagcctggccaacatagtgaaaccccatctttactaaaaaatacaaaaattagccgggagaggtggcaggcacccgtaatcccagctgctcaggaggctgaggcaggagaactgcttgaacctgggaggcagagattgcagtgagtcgagaatggaacactgcatgccagcctgggtgacagagcaagactccgtctcagaaaaaaaaaaaaaaaaatacaatcggattgaaagatctcctccaccatccctttcttttcatttatgtattaataagtactgcaaattaaaataaactaattgataaatagaaatttagattttagaatgcgattttaggcagtatcccacgtaatttgatgaaaaccacggccaattatacagtggctttcttgatcttattaatcacacatgttcattgttcattcattatgatgcaagtataaagctattttgaaaaagataaagttatctatcagtagctgaggtgtggaatactacagaccaaggcctgatgcggtgcttgcctatgttaaagttttaaggtaaaggtagatgacacacagatagatagatgatagactaatcatgcgattacaacacatatagtggttatttactccgaatgagattgcatatttatagcttgaaatagttccttgctttttttccccttccatacttccttctttcctttcttctttctaattgccttgtctaaaagccgtagtgcttcaaaaagtattcatctaatcacctttatatagagtaaaatataaaacaacttataagaaatggcctttatgttgattccagcttcaaacacagtgctactttctataaaataggtgctacatatttttcaaggctttgagctccttgaagccaaatattggtttagtttgattagttctctactgtatcatcaataagtgtttactgaatggatagatggaaagttgaatggaggaatgaacattgatcgattgcttaattagatttctagccttgaaaaaagttgaattgtttcttgtcagcaactttgaagtatcatatgttcttagatgctgttaagatactacacacaagttgaagcatttccagttccactaaggtcagttttaagaagtaaaatttctggaattttttctcaagaagggaatattctctgagttagattctagagtcttagttgatttcctgctgagtgtccgggagtctctcctctatcgctgatctgcgtgtcatgttcatacaaaccaaacacacatatctcactgtttggaatgggtctacgaatgtgaattttaaaaggcattttttagatagtttttaagagattttgatctgagtgaatttcaaacctctgcaaaattcccaccaccaaaccccaataattaaatacagattactcattgttgccacctcctatcattttgaaatgaatcaggaccaacatgtcattttatagaatcagatgacatgttatataccttcattttggtaaccatgttacaatgtatacatatacgaaaacatcatattgtacaccttaaatatatacgatttgtggtaaccatttcacaatgcttgcatatatcaaagcatcacacactgtacaccttaaatatatacaatttttgtttgccagtcatacttcaatagagatggaaataaaataaaacatatgtcaaaaaattcagacatcgcacaaagtattcgccagtactactccagtatgagccaatatccagcaagtgttcaaatttcaacttgtttcataaagggcaaaaacagtaacacagaaggtttgatcacaaaaagtgaactatgaattataaatgtgcaagatatcttttaattatcttttaatccacaggctcttctctgtctctttctgtctctgtgttccttgcaagttgtattgtgaattctactctcgcaatttctgaggcagtgtattagactgttttcataccactgtaaagaactgcctgagactgggtaatttataaaggaaagtgttttaattgactcacagttctgcagggttggggaagcctcaggaaacttacaatgatggtggaaggtgaaagggaaccaggtgccttcttcagaaggcggcaggaaggagtgctgagtgatgggaggaatcctcttataaaaccgtcagacttcataggaactcacctgctatcatgagagcagcatcagggaaaccactcccatgattcaattacctccacctgttctcttccttgacatgtggagatgatggggattataattcaagatgagatttgggtggggacacaaagcctaaccatatcaggcagtattgcaaaaacacacacagagaaaaaggaagtaaatattgtcgtcccaactccaaggcctctatgccttacttgagtcacacaggctaacacagagtgccttagtttgcattcatttgctacatattcaatacattgttgtgaggataaaatgagttaatatatttaaagcagtgacaacagagcctgacacatactagggaatttgcaagttatttattaatattgtctgcaggagccatgaggattttgcaaatgatcagcacgatgtgtttctgcaaaatgctggggccgtgctgctgtcacctatgcttggtccagaccatagagatagtgggtaaatgaaaaccagagacagagtacagaattgcaaggaaagacaggtgtcatccatcaagcaatgaccaactggagacctgctggcaagcacagaacctgcctgtcctctgatgttactggaaaggtttttcaaaagtgtacaatctaaatgtacagtttcaaaagagggaaaaataagctcccatacaataatatgaactctgaaattatgcattgagctgctacttgggatttttgctagattcattaatatttaattttatgatatagttcctaaagaagagttgtttgctatctgggttactgctatggctttccaactgtttcatgaaaaccatttgatctttgccttatcaaaaataataaaagcaaaacataaaaacaaaacactaatatgttgggtgcttggtgagaccattcatttacagatacacgggcgttgggtcaacttgattatattcacacgcatctttctttatgtggctcagcgggaattgccactgtactggaactcatggtgttagataaatgtattcaggttgaaaatacctgttgggctttggaaatgccatttatatcaatatgcatagctggaagcatcagaaaatctaaatccgtgaaagaaggcaagaagtgcattgcagtggaaatttaaaatttcctaagaaaatgggctgtcacaatagccacatgctagctctggaccacccacttcctttcttagaacaaaatcctatggaaatactcatacatgatgaatcccatgctacttatttgccttccctagattctcatcacggctgcacctatctcccagccccagctactgcctcctcccatggcccaggccagagctgttgcaactgcctcacctcccagcactgctgactctcccagctccccagggtgagcacagctctgacacccagaccagaccctgtggcatcccctgagtccctgactcttctcagcactggggatttgaatgaggctccatccctgcagtgtgtgatacctggctccatggttgaagcccaaagggccaggtgacacaatcaggaactgtgggacaaacttggattcatctgaagcagaggggagccagcaaatgcactcctcgctctttcttcctcggtggcattttccgaggaccagggttctgctcagcctgaatggagcaggctcacatagttaaatgaatgtctggaaggcaaaggctggctttgtcccgtgacatcttccctttgctctccctacttctgtactctgtttctccattccctcactcgtggtgcgctgggattttacctcctaataaagtatccacactgaaagcttgcctcctgctctgattctagagaagcctggctgagactgacacacgagaagaggaatgtatgcagactccttggccaagttgcatgtgacagtgaaaacccaaacatgtctatcaaaagaaagactggctctatacatttcagtgcattcaagttatggaatactatgcatcctttaagaaaattgaggtctagctctgttgaagggtttctgaactcttgttaggtgaaataaatagcagtgcataaaaatatgattgttgcctagttttcaaaagtgatgtgggtctttctgttccaatttttacccatatataaaaagttatagagggaaacctagatgtttccagtttttacttttgagttgtgggatgaagaaggaccagggaattaacagttattttttcattatttactttataaatttccatgatgtttaaacattttataagtatatgtaattagattaactgaatataaataaatcaagagtgtgcaatattgaatatcacttttattcacaaaagtcttgaagtctgcggttctggtacacaggaatacatactttacggttgtccataaaaacggacatgtgttatgcattattttcaattcttaaatgtcaccttaaccaattataagattattgtagattaggacaatataagagaccacttttatactctaaaattcttaaatctaacattaacttcttttcattgaaaaaagagaatataaaaaagagagagagaatatatgataaattaaagaccagccataattaacatcaggcagacaataaagaaacagatgtgtaagtagaatgtgtttgcttttggttttgctctattccatggaacgttttattacttcatgaattgggaaggtattttcaagattaataatcagagaaaatggtgccctaatgttttttaaaaatctgtattagcagagaatataagaagaaattcatactttttaaagaatgtgatcattaactaaactacaacatttaacacaaaataggcttttcataacagccatgcagtaaaaaaatataaatagatacactatcctagatatcaactaccttgagtttaaacttttgactgcattatatagtctggttgcagatatatgctttcattaaaatttagtgattaccaaatatttggtaagtgaaagtcaagtaactcaaagttatgaaattcgagtgattaaaatacagagagcattaacataaaggaaagagatccagtttccctacagacacaactcctccactgtttccatcaaatgataaaacaggatggaattagcactatgttaaatgataatatatacgttcatagccacacagatgcttttctatgggaaaatacagttctaaattatagcaggtgtacaaaattattattgccatatttattactagatagatttattttgtgtcacaaatttgatgacatttataaatttatttaaaaataatacaatgagaaattgtttctcttttaaaattcaactggaaactgatgataatgtttggaaatggtatgtagtaatatataacaaaatataaaatgtatatatattatctttatatcatctattctatttgtatgtctctgtgtgtatataggtataatctatacctataactacacacatatgagtgattgccctgttagaaaacgtgcaaatattacttcattcaatcctctcaaaaatcatctgaaattggttatcaatttctattttgtagaggagctgatacagcacatgatatttttacaagctttttttttacaatttttacaagcttacacagccaatatttgacagtcaccagtgtcaaatctagttctaactggtaccgcatcaaatactttcgaccaagacaccatactgttagttgtgtttttattcttaggtaataattttcaattaccttcagaattaagtagatgattgaacacttgttcattatgcctcaatttagacgaatgaaaatgattggttttttaataataacggtaacaataatgatcccactaacactaatatgaaaataatacgactgtcattttagcactttgggagaccgaggcaggcggatcacctgaggtcaggagtttgagaccagcctgatcaatgtggcaaaaccccggtctctactaaaagtacaaaaattagtcgggtgtagtggtgtgcacctgtcatctcagtttactggggaggctgaagcaggcgaatcgctcgaacccaggggatggaggtttcactgagccgagatcgcgccactgctctccagcctgggtgaaagtgtgaaactctgtcttaaaggaaagaaaataatacgactaataaaataacatacagagtaggctcaggcatttttctaaacagtttgcatatgtaaatttatttaattctcccatcaacccattatttctcaattttgcaggtaaggcaactacagcagtttggtgagaggtcgttttaaattgctttttccagtaaataagagacaaagtagagatccagggaaagcagtgatttttcaagagccatttccgcatttagcagttttgtgaactgaatttaaaggatgtacaaacgtgtaaatatctaaggcacttgtagaaacacacacacgtagacagtagggtcttagctcgaaaattcaactccgtgtcttgtggcaacatatttaatgtgtaatactgtaatgatataaaatattgagaatttacactctgttaaatgttgccacatgtagtaaaatgaatgtatttattagagggatcaaaacactcttatctttaagctactaaaaacctaactgcattgaatactaatacggcattttgtttgacaatttacacacacacaaatcaagggattctaaacatataacttttctcagcaccatcattctatttccaatctggcattgcgacataataaagttaagtgcaaggtgatacaaaaatacagcgctgatgaaaaaagcgaaattatggctgctctgggactatcccttgcaatttgcttactcaaaggtaaaaaaaattatatccgaggttggctgggataggaagagtgttggcctcagataattgctgcctataaataattatactttattggaatgtctttatttacaggggtgtatttaagttctgcatcttagtaatacctttcaaataattaagtgttggccaactatttaaagaggaaagaaattaatcgaatgctcttcaatgacaagatataaacagtggggcaattaattttccagaagcacattgatgagtagggagtgtttatcaatttgcatatttaacaacccccaaacactccagctttcttagcttggcaaatgattggaacgatgcaccattttttagttttttgctgtcacagtggttaaataaattgtaaatataaataatatgtgtgtagttcatgaagttcatatcacaagggtcactttattttcttaaattctaagcaaaatattactttctgtatggcttaatttgagcaaaaaacaaaaacgcaatcaaagcctgccgagaattgagtagtaatatgctgaggaaatacaatgtctctagtatttaagattgttccatataggttggtgcaaaagtaattgtggtttttgccattaaaataatggcaaataaattataattaaggaggtcacaaaatgtaaaagttttatattaatggtaaagttataatttttaaaaatcatgaaaaggtaaggatcctgtatcattggaatatttttgcttttcgtccattaccttgtgtttataataattttaaaaaatgagtttgaacgatcgaggttgaaaattattgtttgtgttaaattagtatcttattttttatttatttcattgtaaatctggtaaagagaagagagcattagaaccagcatatgaatctcatttgaggttatgactcagctacttataagttgtgtgtcattggggaaagagctgagcttctctgggtttctatttatttagttgttaaaaaagccaataacacttatgttgtggggattaaaagtacctagcataaagtagatgctaaaatgcactttttaaagaaaaaaacaaaagagaatagaacaaacttcttttatcaagattatcttagagaaacaattagagagatgttaaccacaggaggttactcttcaaagacagtagttgttatttttggttgtcagtttgtaaagaaatctctggagaagtcaatagatcactagataataaaatatttgcaagagtactaagaaccaagaaagtgaagagatttaatgtgaatttcaagagagcctggtacattaagtttttatagaaagcttttcattttaaatgaaatggtggtcatccacctcttaaacagatgtcataaactttgcagcataggatgacataattctagtcactttgaattagtagtgcagttggattactgttattgatggttcacataggcacagaaccattaaggtgtcaaaaactgagagacttaatatgacataataccagccttttaaatttagatgttgctattaagttacatctcaaggacttcctgtgtaaatatatttttaaaaaattttcaagttatctacacaggaagatgaaagctcctcagtgatttttctttcaaacctatgattaaatttggttaaaattaaatggaaaaaataggtcccaaaatgcataagaaagaagattaatttttaaaggaggaccttttaaaaaactgggcaatgcatagattgaggttttgtttggggctagggttgagcttttctctcttatattaagtaaatttagatacattttgcattagaacaaatctgattgatggaagtacccctcccaatgattataaaaataaaaatgcaaaattgaagtgcattgtacttagatcttcgtaaaaatggaaactgaaaaggcgtatgcaacagtggaaattggaatcattgcattccatgttggggtgatgagcgacattcttctccaagtgattttctaatatattgttgcatcatgtttaaagtacgaggaaacctactgaagctgtgtatatattactcaaagtcatcagttataggcagaaagaaaatgacaacctattgaagctgtgtatatattactcaaagtcatcagttataggcagaaagaaaatgacaagtcagttgctgatttcgtcttgcagtaagttacgagattcttaatgagattttctctttattcaaaacagaagcagtatgtagtattttcttaggatgaataacatagaagttttatgttggtacaagtatttaattttttaaataaaggacttatcattatgcatgagaatgatattagaacatgtcattaaagtaaaacaagaataagattagttgtgtaaaatgttataaaactttgaattttatcactattacataattcatccaggtaacagaaaaccacgtgtaccccaaaacctattgaaataaaaatttaaaaaataaagcaaacacaaaaataaaattttaaaatttaaaaaatcagactaaattttcaaattatataataatattataatatttaaatatgtctttcagaataccagtgttgtagaacagttatatcaagtgtgtgtgtgtgtgtttgtgtgtgtgtgtgtgtgtgtagtagaatccaatatttcagtgatattaggccaattactttaaatgttatatacaatgaaaagattacagagaatacaaaaattatctgctttagctaacgtatgaaaataatcaaattgttatgactcatatggaaaatatacttcgaattttttaaaattcaaaggtagtttctgcagagacctttatttaaaccaggttagtagaactattaatatctgcttgtgtgtattcattgaatacaattttaaaattaataaagctagtaactataataatgatataaaataaagatcattatgaactctggcaaaacataattatgatgatcactctgcccataaaaaaatcacatatgcaaaaactaaatagaaatcaaacaatgttatagggtttctgagcaatgatttttgtctattgaagtagataattaaaggcaaatttgtggatatagtaaagtaaggaagtgatattttttaaaccattgaaagacaaatacatttttacgtaattacttgttttttgttttcattctaattatatgtcgtcaatttggcatcatccttttttagttctaaatttgtgtgtgtgtgtctttgtgtgtgtaggtatgtatttctcaaaatgctaagtatgttattttggacactttactagcaacttgaaattcagtctgttttggttgtacttcattattatttgaggtgtcgggaaaatccacagaagtgatcaatttaataaaaaatacccagacaaagttttcaactataattttatagactgagttatataattacacttttttacttgtaacatggcaaaaagtggtccatgaaataaacatgctattaatgtaaagcatattgccatatatagacatgtactgaataaaatatgaatcatttttcaatcatgtcttgacatttattttaggatttatttatgaagaaaaataacatttcacttcctttttgcttttaatttaatttatacaattttgtgaaggcagaataaaatcaagaaaaagtataaaaaatttcatttctttttcctaaaggattttcatgttctattcaaatgtactccaagtaaagaaaatatacaaatcaacacatttatcaaaagcacaagttacattgtatacatttttcaaaggataagtcttttattgttgattaattaaatctaagatatgcacacatttagattcaaattagacattcttgctgtgtcccctgggtggatatggagaggtgggagtgttgtttttgtgagaatatgaagagattgtgcaaaattgttgctaaaaaaatgcaggaatgagaatatgggataccaataggaatgagttacccttttcattaaaatattcaacactgaactaaatgttactagaatatgtataaaatttaaaaatgaatgttctagaatctggattcatgctctggtctattgagtctcatggggagggccaaaggcattctctttacttaaggcttgcattcataataatgttggccaaggacttctatgattttatgataatatgacaataactgccatttattgagagctttttatataccatgcgccgttctaaaaatttgtatatgtattctcagataattctcaaaacacatgattatttttcctcattttggagatgaatagtaaaaactgaggtgaagagaaatgaagcaccttgtcaattcatatttctaattattaatgtaaactcagtaatttattatttcatttttcatgatcctagccactgagctttccggctactataacagtgttcaccagaatcaccagggacctcacattgtcaagcccaagggtcgctgtcagagtgtgttccccttgatctacgggggtatttgctggttccctcttgggcaccctgacttggctttgtggccattatctctcttagtttccctccagcctctcttggtgctgtgtctcccacggctctaccagtccttcctcatgttcctgacttctgaacatcttaagacttggagtcacacttgggaggtcttcaactttctagctaccccaaatccctttaggctgtcaccggatttcatgattccaagaaccttttccaagttgtcgctactgtgtttttatttccggcccagacgtccttgaacagttcctcccatggccttgcttatctcagtaaatggcacttgcaggtgttaattcaagaaacttggtgtcctccttggtttctgtttttctctaaaaccgtattccaattttttatcttattttaatggttctaacatcaaaatatatccacgatctagtctcttcttaccacctccactactcttcttcgtccaaaccacgatgatatttcactgcttatcactgcagacttttaaccattctttttacttttaatgtagtcacacatgcctctacccaacacagagttcatcatctacttcacagctacagtgattctttgaaagaactactgctagccaaatcaagttaattctccatctgtgcaaagccctctaataattttccatctcattcataaggttctgatgatggacattgatactctcacttacaggctcccagtacctctgtgagctcatctcgttcactcctctctacctcactttctgtattcaagccccccaggcctcgttgaggttcaaggaacaataaaccactcccacctcagctcccgttcactccctgatgcctccttgtccccagacccttagagctgactcactccttccttccttcttggatcagaagacgccattcccagtagcatttccctgagcatcctgtattaaaacgcaatccctcctgttcagtaactccaaaatcctactttattttcatgttcaatactagttaatgcataatattctatatatttatttatatttgttgcatccccgttttgaaatgtaagtataataagtggaaagttcttcaggttctccctctgtctctcttcctctgcttcttgagaactaaccattgtttctcacacatattatgaaatcaatacataattctttaataaattttgagcaaaaagttatttagagctttatatcttagacattttgttcaaaatgtacatcctttgtacattctttaacgtatgccatatttaaagcaaattaacctattttttgagatcactgtgttgttatgtggtagaaaataccacaaagttttaaatgcatatatattttagacaaattttaattatccacagcctctgttcaaagaacttcagttgacaatcctaaatagtgtttgcatttttcttcgtaacatccacctatgtcattttctccatacccctcacttgacactaaatcgcagacacatcatacaaacatacataaaggattgcttagttgtctacgagcacttccaagaactctggtcgctttcttcacatgtttctggatgtttacagcgtagtaatagagtcaagctgccttcagaaggaactattgaacccataaagcctgaaatgtcaagcttcacatttttgtttgatatggatgtaagttcacgattatgtgcatactgtacctttgttgctgtgactttctgaatgtatagccgcagagatatattactgtctacagaagtaatgaaatagattagagcaggtctctgagataaatgtcagaatctattatcaacttccatttatgtatttgttcaacgaacattcactaaatacgtactaaattcaagaaacatttctggcccctaaaaataagataagattctggagctttagaacaaaaggagcttttagaggaaaaggagacatagataaataagcacctagaatatgtattacaatagtagtgagaacgtgaatttttggcagcacaggtttacattcttgaaactgaggatatcagagctgaagtttgagggatgaacagagattcactatgtagagtcagaggaaggtttctctagcaggagaagcagggatgtgaacgtttttacgcagaaataattatgctgtgttggggacactgcaaatgattacaggaagttgcaatttggtattatcagggatgtagtgataaattaccaggaacgtatgcccatacgaagagcactgtatgttacataaatgtatttgtctttattccagagtgaatgaggaacatttcaaacattgtgagtaggtgtgttaggctgtattagcattgccataaagaaatatgtcagagactgggtaatttataaagaagagagttttaattggctcatgattctgcaggctgtacagaaagcatggcacgagcatctgctcaagttccagcgaggcctcagagagcttttactcatggtaaaagatgatgagggagccagcaaattacatggcgagagcagggccaagagagcaagggtggagtggcacacactttttttttttttatatactttaagtttttgggtacatgtgcccattgtgcaggttagttacatatgtatacatgtgccatgctggtacgctgcacccactaacatgtcatctagcattaggtatatctcctaatgctatccctcccccctccccccaccccacaacagtcccctgagtgtgatattccccttcctgtgtccatgtgatctccttgttcagttcccacctatgagtgagaatatgcggtgtttggttttttgttcttgcgatagtttactgagaatgatgatttccaatttcatccatgtccctacaaaggacgtgaactcatcatttttttatggctgcatagtattccatggtgtatacgtgccacattttcttaatccagtctatcattgttggacatttgggttggttccaagtctttgctatcgtgaataacgcggcaataaacatatgtgtgcatgtgtctttatagcagcatgatttataatcctttgggtatatacccagtaatgggatggctgggtcaaatggtatttccagttctacatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagggatgatgagcattttttcatgtgttttttggctgtataaacgtcttcttttgagaagtgtctgttcatgtccttcgcccactttttgatggggttgtttgtttttttcttgtaaatttgtttgagttcattgtagattctggatattgcccttggtcagatgagtaggttgcgagaattttctcccattgtgtaggttgcctgttcactctgatggtagtttcttttgctgtgcagaagctcttaattagatcccatttgtcaattttttcttttgttgctattgctttttgtgttttagacatgaagtccttgcccatgcctatgtcctgaatggtaatgcctaggttttcttctaggttatttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgcagatatgtgacattatttctgagggctctgttctgttccattgatctatatctctgttttggtaccagtaccatgctgttttggttactgtagccttgtagtatagtttgaagtcaggtagcgtgatgcctccagctttgttcttttggcttaggattgccttggcgatgcgggctcttttttggttccatatgacctttaaagtagttttttccaattctgtgaagaaagtcattggtagcttgatggggatggcattgaatctgtaaattaccttgggcagtatggccattttcacgatattgattcttcctacccatgagcgtggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcgtgatttggctctctgtttgtctgttgttggtgtataagaatgcttgtgatttttgaacattgattttgcatcctgagactttgccgaagttgtttatcagcttaaggagattttgggctgagacattggggttttctggatatacaatcatgtcgtctgcaaacagggacaatttgacttcctcttttcctaattgaataccctttatttccttttcctgcctaattgccctggccagaacttccaacactacgttgaataggagtggtgagagagggcatccctgtcttgtgcccgttttcaaagggaatgcttccagtttttgcccattcagtatgatattggctgtgggtttgtcatagatagcttttattattttgaaatacgtcccatcaatacctaatttattgagagtttttagcatgaaggtttgttgaattttgtcaaaggctttttctgcatctattgagataatcatgtggtttttgtctttggctctgtttatatgctggattacatttattgatttgcgtatattgaaccagccttgcatcccagggatgcagcccacttgatcatggtggataagctttttgatgtgctgctgcattcgttttgccagtatgttactgaggatttttgcgtcaatgttcatcaaagatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtggaattcggctgtgaatccatctggtcctggactctttttggttggtaagctattgattattgccacaatttcagatcctgttattggtctattcagagattcaacttcttcctggtttagtcttgggagagtgtatgtgtccaggaatttatccatttcttctagattttctagtttatttgcgtagaggtgtttgtagtattccctgttggtagtttgtatttctgtgggatcggtggtgatatcccctttatcatttattactgcgtctatttgattcttctctctttttttcattagtcttgctagcggtctatcaattttgttgatcctttcaaaaaacgagctcctggattcattaattttttgaagggttttttgtatctctatttccttcagttctgttctgattttagttatttcttgccttctgctagcttttgaatgtgtttgctcttgcttttctaattcttttaattgtgatgttagggtgtcaattttggatctttcctgctttctcttgtgggcatttagtgctataaattttcctctacacactgctttgaatgcgtcccagagattctggtatgttgtgtctttgttctcgttggtttcaaagaacatctttatttctgccttcatttcgttatgtacccagtagtcattcatgagcaggttgttcagtttccatgtagttgagcggttgtgagtgagattcttaatcctgaattctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatttctattaggtccacttggttcagagctgagttcaattcctgggtatccttgttgactttctgtctcgttgatctgtgtaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtgttgactatttatccaatttgccagtctgtgtcttttaattggagcatttagtccattgacatttaaagttaatattgttatgtgtgaatttgatcctgtcattatgatgttagctggttattttgctcgttagttgatgcagtttcttcctagtctcgatggtctttacattttggcatgattttgcagcagctggtaccgtttgttcatttccatgtttagtgcttccttcaggagctcttgtaaggcaggcctggtggtgacaaaaatctctcagcatttgcttgtctgcaaaggattttatttctccttcacttatgaagcttagtttggctggatatgaaattctgggttgaaaattcttgtctttaagaatgttgaatattggcccccactctcttctggcttgcagggtttctgtcgagagatccgctgttactctgatgggcttccttttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccttatttcttggaggctttgctcatttctttttattcttttttctctagacttcccttctcgcttcatttcattcatttcatcttccatcgctgataccctatcttccagttgattgcattggctccagaggcttctgcattcttcacgtagttctcgcgccttggttttcagctccatcagctcctttaagcagttcttggtattggttattctagttatacattcttctaaatttttttcaaagttttcaacttctttgcctttcgtttgaatgtcctcccgtagctgagagtaatttgatcgtctgaagccttcttctctcagctcgtcaaagtcattctccatccagctttgttccgttgctggtgaggaactgcgttcctttggaggaggagaggcgctctgctttttggagtttccagtttttctgttctgttttttccccatctttgtggttttatctacttttggtctttgatgatggttatgtacagatgggtttttgatgtggatatcctttctgtttgttagtttttcttctaacaaagaggaccgtcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagatctccagctgcttgctgggagaaccactgctctcttcaaacctgtcagacagggacatttaagtctgcagaggttactgatgtctttttgtttgtctgtgccctgcccccagaggtggagcctacagaggcaggcagacctccttgagctgtgctgggctccacccagttcgagcttcctggctgctttgtttacctaagcaagcctgggcaatggcgggcgcccctcccccagcctcgctgctgccttgcagtttgatctcagactgctgtgctagcaatcagcgagactctgtgggtgtaggaccctccgagccaggtgtgggatagaatctcgtggtgcaccgttttttaagcccgtcggaaaagggcagtattcgggtgggagtgacccgattttccaggtgctgtccgtcacccctttctttgactcagaaagggaactccctgaccccttccgcttcccaagtgaggcaatgcctcgccctgcttcagctcacgcacggtgcgcgcacccactgacctgcacccactgtctggcactccctagtgagatgaacccggtacctcagatggaaatacagaaatcacccgtcttctgcgtcgctcacagtgggagctgtagaccggagctgttcctattcggccatcttggctcgatccggagtggcacacgcttctaaacaaccaaatcctttgagaattcaatcactactatgaggacagcaggaagccatttatgagggatctgcctcggcaacccaacacctcctaccaagccctgtctccaacactggggattatatttcaacataagacttatagagagcaaatacccaaatcatatctttccactcctgcatccccaaatctcatgcccttctcacattgcaaaatagaatcatctcctgccaatagcccccaaaatcttaactcacttctgcattaactcaaaagttctatgtctcatgtccaatgtctcttctggagatgagttcgttccccctgtgagactgtaaaataaaaaccaagttgcatacttccaagatacaattgtgttccaggaattaggtaaatattctcataccaaaggaaaaaaaatggccaaaagaaaggggtaataagccccacataattctgaaacccagcagagctgtcattaaatcttaaatccccaaaattatctcctttgactgtatgtcctgcatccaggtcacactactgcaaggagtgggctcccaaggctttggtcaggtccactgtggctttgtggggtgcagtgtggctgctttcatgtgctggagttgagtgcctatgacttttccatgacgagattgcatgatgctgttagatctaccattcctcagtttggaaggcagtggtcttcttcccacagctccactgggtagtgttccagtggggacattccatggggttccaatgccacatttccctttggcactgccctattcaaatatctgtgtgggactctacctttgtggcagccttctgcctgagcactcaggctttctgatacatcttctgaaatctatgtggaagctgccaagcctcctttattcttgcattctgtgcactagcaggcttaatatcacactgtgttgaagctgccaagcttatggattgcaccctctgaagcagcaatatgagctgtacctgtggcactttgagccatggatagagctggagcagtggggatgcagggaacagccaccttgcattcctggcttcagagccctgagtctcacccataaaattgttctttctttgtagacctctgggcctgtcatgggaagggctgcctcatagatctctgaaatgcattccagggctttatcccattgtcttggctagcagcacctgggtcccttttagtcatgcaaatctctctagaaagtgtttgctccatagcccacttggattcttccactaaaaacatgcttttcttttctaccacatgggtaggctgcaaattttccaaatgtttatgctctgcttcccttttaaatataagtaccaactttaagtcatttaatgtgcctgcatctgagtgtagactgttataagcagccaggccacatcatgaatgcattgctgcttagaaattccttctgccatgtaccctctcatcattcttaagctcaaccttccacagattcctagggcctgaaaacaatgcaaccaagttctttgctagggcctaacataggtgaccttcactccagttcccagtaagttcctcattttcatctaagacctcatcagcctgcccatcactgtccacatttctatcagcattttggttataaccacttaaccagtttctaaggatctccaaactttccctcatcttcctgtcgtcttttgagtcctccaaactcttccaatctctacccattacctagttccaaagccacttccatattttcaagtatctttatagcaacatcccactcctggtaccatttttctgtattaggctgtttttgaatttccatgtagaaatacccaaggctaggtaacttataaatgaaagaggtttaattggctgacctgtagatgaggcctcaactggtgaggcctcatcaagcattcaatcatgttggaagtgaaaggggcagacagtgcatcacatagcaagagtgagaacgagagagagaggagaggagccacatacttttaaacaaccagatgttgcaagaactctctcactgttgcaaggatagcaggaagccatctatgagggatcagctcccacaaccccagcacctcccacaaggccccacctccaaaactagggattacatttcaacctgagatttggaggcaacaaatatccaaaccatataagtatgtttactgttatagaacaatgctggcaaaaatagattagagtaaacaaacatatatggtgttcccagttgggagaaaatagcagtttcacaagtaaaagatataaagagagagggaatctgatgtaaggaagtatacacattaagccctgctgaggaggtattacaggttagaccttagtgacagatcaagcgtccagagagagattaaatctatagggaaaaaacttagactagtggtttactcagcctgtgtacaaggcagagggagaatgaagagtgatagcaaatgagtataaattttctctatggggtgtgagaaatattctgaaatctaattttagtgatggtggcttcactctgtaattatcttgggaaacatttaatcacacaagttaaaggggagggtgacttaaaagtacgttcatctcaatagacctgtctttgaagaagaagaagtcttaaggttcttgttagtcatatgggtgattgccgatgccacacaatgggactcttagtgaggagagggagagcaggagacattgagaagtcaggtaatcccatagattattatgaaactcccacatggagttggataggctattgaatgccaactgaagatacaggtcataggttctgaacctatgggggtagactacctcaaccctggagaatgtataggggagtgagaagcgccatggatgaaatactcaaatatcaaaaaagaaaaaaaatagaggttgacaagggaagaatttaagaaattgacgaagaagatgcagccaggaaaaaaacaaaaaaggaaaagcaggaattggtgggatcatgaaagccagtgaaagaaggagcttaaaaagggggcgagaaaagttggcatgtatacaccatagaatactatgcagtcataaaaaatgatgagttcatgtcctttgtagggacatggatgaagctggaaaccatcattctcagcaaactattgccaaggacaaaaatccaaacactgcatattttcactcataggtgggaattgaataataacacatggacacaggaaggggaatatcacactccggggactgttgtggggtgtggggaggggggagggataacattaggagatatacctcatgctaaatgatgtgttaatgggtgcagcacaccaacatggcacatgtatacatatgtaactaacctgcactttgtgcacatgtaccctaaaactcaaagtgtatatattaaaaaaaggaaattaacaaggataaaaaaataaccacaaaaagtgggggggcaagggaaacaatcttcaatgcataaaggttcatgtgacatgaggactaaacatactttattgaattcagcaaaaggatgccactggttgaatttttgagggcagtttgggtaaaataataggcaagccactaggtttggggttgaaagaaaattgaggtactggaacaatgagtgcacacaactgcttcacgacactctgcacttcatccagagagagagagagacaaagctaagggggtaaggagcaaggactttgttctgatggaagagtcatagagagaaaagaaagagactaagtgatgaggaagagaggatgaaggatttctacttcgctgaagtcctgggagagagtgctgggggaggagtggtgcaaaggagggaaatggaagattttggaaaataaccaatgtttgcaattgtcatgtgactgaagggagaggaagcttcctgagcaatcaatgaaaaaagagtaaagatgttttttactaaaggcaagagcaaaaaaaaaaaaaaaaaaaaaaagataaattggatttcatcaaaataaaaacatttattcttcaaagagaccattaagacagtaaaaacacaagccgtagaatgggagaaaatgtttggggattgtgtatctgataaaggatttgcatctagaacatagaaagtactcttggagctcagtaataaaatgacagataacccagttaaaaaataggttaatgatcttcatatacattttacaaataccaatattcacataaagagatttttgacgttattaggcatcaggggaatgcaatccaaaaccaccatgagatcctacttcacacccaccaggatggcaagaataaaaaaagccaagtatagtacgtacgtaacacagatgtggagaaattagaacccgcatgtctgctgctggtgggaatggaaaaaagttcagccacattagcaaagagtctggtaattcctgaaatgtttaaacatagcatcataatataatcgagaaatgccatttctaatatacccatgagcaatgaaaacatatacagttacatgttacataacaatgaggaaatattctgagaaatgctttgttaggcaatttcatcaatgtatgaacatcattgagtgcacttactaaaaccaagatggtttagcttcctagagacctaggatgtatggtatagcctgttgcccctaagcttcaaatctgtacagcatgttactgcactaaataatatggacaactataatacaatatcaagtatttgtgtattagagcatttttaaaaatagaaaaggtcactaaaattatggtataaaagatgaaaaatgctacacctgtatagagtacttgtcataaatggagtttgcaacctggaagtagctctgtaggagtcggtgagtgagttataattgaacgtgagatctaggagattactgttcactattgtggactttacaaccgttgtacactgagggtatagcaaacttacaaaaagtatttttttctttattctattgaataaagaaaaaaattaacttcagtttattaaattaacttcaccttattacttttttctttataaacttttaattttttaaacatgtgactcttttgtaataacacattaaaatatgaaacacatgcacaggtgtacaataatattttctttctttatagctttattctacaagcttttttctagcttgaaattttgttttattttactttttgaaaacgtttttgttaaaagctaagacacaaacgcacattagcctagacttacacaaggtcagaatcatacatatcactgtcttctaccaccaaattttgtcccactagaaggtcttcagggactataacaggtgtagagctgtcatctcctaggatgacaacgctttattctccaatacttcctgaaggacctgcctgaggctgttttacagttaatacttttataagtagaacaagtaccttctaaagcaacaataaaaagtacaatatagtaaaactataaaccagaaacatagttgtttattattattaagtattatgtactgggttgggcgcgttggctcacgcctgtaatcccagcactttggaaggctgagacggccgaatcacctgaggtcagcagtctgagactagcctggccagcatggtgaaacccagtccctactataaaaatatacaaaaattagctgggtgtggtggtgggtgcctgtaatcccagctactcgagaggcagagccaggataattgcttgaaccaagaagacggaggttgtagtgagccgacacggtgccacagcaccgcaggcctgggtgacagagtgagactccgtctcaaaaaaaaaaaaaagcattatgtactatacatcattttatgtgctagacttttaatgactggcagcacgatagatttgtttgcaccaacatcacaacaaacccatgagtaatgcactgcgttacaatgttggaagaccataggccattactagctcataggaatttttcagctccactataatcttacgtgaccaccattgtataggtggcccatccttgaccaaaaggtggttatccagcacatgactgtattcacacaaaaactggtacaacaatgtttatgtcaacattattcaaactaggaaaaagtggaaacaccccaatagtctatcactagatgaaaggatagacaaactgtgccatttccatacaatgaaatattattcagccagaccaagaatgaagtactaatacatgctgcagcatggatgaaccttgacaatatccaaaaaaaataacacagttgcaaaaccatacagcatgtctatgactccattcataggaaatgtccccaacagggaaatctacagagacaaaagaagacgagttgttgttcgggccctggaaggagagggtggtgtgtgtttgccttgaagggatggggggtggtgcttgctaaagggtacagggtttcattttgcagtgatgaaaatatttaaaattgactatggtgatggttgcatatatctgggaatataatgaaacactgaaatttatactttaaataggtatattgtatagaacttatatctcaagccgtcaaaaaaaaaaaaaaaaatcccgatagagaggaattctatagaagacctgaccaacggtcctgaaaactgtcaaggtaggcgtgaagaacaagaaaagtcaggaaactatcatagtcattgaagagcttaaggagaaaccatgtctaaatgttatacagggtcctcggtggggtcctggaagagataaacgatattaggcaaaactgaaaagaatctgaatagagtatggactctttaataaaatattccagtatcggcccactaaccatgacaagtgtatgacactaatttaacatgttaatagtggggtagtcgggtattaggtgtatggaaattctctgtacaatctacacaatttttctgtaaatccaaaagtgtttgaaattttaaaatttattgaaaaagatttatttttatttggtatctgaaaatgtgatgttagtgtcattgtttaggattcaaatgtgcaagatctgttgtctgaaattatttatgccaattctcttaaaatcttctttgagattctaaagtgctaaagatataatgcatcatcaaacgcattattactttaagcattaattaatttcatatagtgagagaccttagatttgcatgcaaaaagagagtgacttacgagagagtggcattcagaaacaaagaagtatctgtaagttctcttttcacatcaaagcttgatacacgagcagagcgtggtgccctattttgacaaagttcgccaattatcagaacaagaatgctttttaaaaacacaagttgtttcttctactgacaaatcattaacgaaatgatgtaagggatcttgaaaaaaaaatcactacataatctttttctcccaatgaatagcctgttttagaagcacatggtttttagtttccagtaagtttcactattattctatttcaagaatatttacagatatagttgatatataaatatacgcatatatatgccagatatagttttgcaaacacatttgctgtctaatttactttctaacttagttaaaagataagatacccttgacctgggaagcaagattaagaatcagaacaagattttaatctaaaatgggaccaagttcaagaaaggagaaatttaaagtgttagtctacaagtccatgttgtcatccttagctattacaatttctaggaattgctggagtagtcaccaaggctgagcctcctacagggggtagaaaagtaccatgagtttaaagcagaatcttacaggagcctgtggctggaccaaaacagcaatgtcggttgtgggagttgctgtcaggaggctggtcacaggctcagtcaaccaagacagagagccgtgctgccaaaacctcaaggacaagcctggctggggcactggctgagttagtgatggctttaggaaaaccaccatgtcagccctccaagcaaggaaacccatctataaacccatatgcacacatctccttacaggctgttagatagtaaggtatacatggaaataacaagttaaagatcttacttcacacatttccaaatttgaaagtaagagctatattttttgtacaggtcaaaaagaaaaaaaagatcctggacatgtgttggtactttggtgcatgtgctagttttcatacacaatagtatgcaggacaggagaaagagatgaggtactcaatggccacgtggaagttctaactcctgcaactgtttgatttgggacgtagcacaacaaaccgggattggcaaaagtgctcattctggaaaaacaaagaagtgagaaagtggatggccagtataatgttctgactcagcaaatttatagccgattctctattcttttgtaagtgtatgcaaaataggcaaagttcataggctagcgtaaccttgtcattttagttagccacggtgactgacaaaatcctcattaggtagtgggaaaaattcagctacaaatcgtatgtaaatttctgatgtgaatatcaattgtctttagtaaaatccgcccttgtgatactactcacgtgattcttgagcagctccctgagcaccggccagtgctccctctctgtgctttcggcaaacagcacaccattgtctcctagaccttgtcaaaatattacacatctttctttcccgtctgtgcttcttcaacactgaatgcaaagctcctaaaagagagcctggcacatggtaggaacccaataaatattggttgactatagaaattctaagaaaccacgtaggccaaagttcaacagtggccaaaatacgtagttgaggagaacgtgacttcaaaattggtgaattgtcgttcagatgttttgctgattgcacttgaagatttttggttgattattggttgattcaagttctcaatgagagcaatggatatcacttgtaaacaggatcatcccatgtatggtgtgtgttggtgtggatatgtatcccctggctagctagtgtctacatcaagaaaacaaccagcacattaacagtgttcgttttctaaatcgaaaaatgttgatggctttcttgtgtctttatcaaatataatactgaacagtacaataaccaaaatatgtagttaaaaatatttgtgtaataatgtgttatactctacttctcataagaggtgattattgttagtgataatttttatatactaataaaactgcttaggggagaataaaaacacagatatgtaataaagaaaattagatagatagtttttacattatttagtagaacttaatttgtaaatatgcatgtaaaatgctaagtattatgtgaaaatgatttttaaaatgctataggtctgattattaagcttcatgagctgccaaattgactggtgtctatttgggaaacacgaagttaagtaaaaccatactcttgtatactgtgggggtactgttaagcagatgtagtactggcatatctcttagctttttaaatttttaaggctggtttggattgtcccgtgaatgagaaaacttttgtcagttagtgaatttgcctggagaattaattaagcttatcactgagatggttttgaaataatcataattatcactacaattagttgtttagagtctaagataataatgagtaaattctatttctttttgatcctaaaaaattatattttttgcatggattgtttagaaaagacgcttattaaatggagttacagaaaaagcaatctgtgtccatttaatgttgtgcacccctcatggctggttattgaatctcgagccagtcgcagcaggcagtcctgaccttgacgcggccaagagtgctgattgaggctgttatgagcaaaaagatggcattatgctgagtaaagaaaaatcgaaaataaaaggagtgggtgaaagctgtagcatccatattcagatctgttaatttcctatgggaagggcatgagtttttcccagtgatcttttctgcaaaaaaaacaaaatgtatcaataacggcactatctactgatgctggaggacatttaggtaaacaaaaacaccgagtccccaaatgctagttttagctggaaaatgtaaccttactacttgaaattaccaggtgcctacaactaacacttttttttccagtgctacgtgtagtagaacttgactcatatttggttgaaaaaatatgatttgtaaatcaaaaccagtgtcagctcttagacaaacacttcatgcattatttttcccctaaagatagaaagctgaggcatttaacatgcatgcagtgaccgtagtctacaggctgagagcatccttctcaaatgtctcacaatctcatttttcctgctgattcatgagaaacacactttccgttacagctttctctatcttagcttctgaactaactcctgtgcacccagaaaagagctcactgggtgtgttaggtaaggctttgttaaattgcggttgactccaaattcagggttcagctctcctgtgcttccactgattctattttacgttgtatcagtttgttcattcaacggatacgttccagagacctcttatgtacaacctcactgcactgtgataggcattgtgtaaaacagaataatatattctggaagagtagataaaacacataccaaaataattacagtgaaattcatttaataagattcaggcagagttccctaggtccatagaaaacagaactcctggcttggacaatggaaatgtctcctggaattggacagtacctttagattgggcctttatgatggtgaagacttggaggtgcagaaataggggagttagatcgattagtctttgctactttcctttatacacacaatttctctctcggttttgttgttgttgttgttgttgtaatctctccaaatgtactgtaaggaaagtcatgaaaacaatgaagggttcttaaggtcgtaatcatccctaaggtatatattttaataagatactaagttttgagcctcaggagtgaatctctggtggtagaaatactggtacaagtactgggccatagatgggatgtttttggttagggagacatcgtattcccctagaatcacaagatgcaggaaagcgccctgttccatctataatcaatgtagtggtttggaatgttcctgcccaggaagaagactggtagtgtacccttgggcatgtttgttcatttcctcgactctcaattcgcacatcctaacaaatgagtctggttatatttagctttaagagagtaaattagcatctcttattttgacttcactcagttgatgttagagtcctggagtagcatgttagatgactattcaacaagctctgaacacaaaggaaatgagaatctgctgattttcacatacactggtcatccaggattatataacctttaagatttattccaattctacgtttccattgttctattgataagcctttaagcgttgaaaaaagatttaacagctacgctactttgagaaagtgactcactgttttgaaattgttaccattaatgtgtaatgtgactattaatttctgcttttcaatgctagcataataaataacattcaaaaactcttttgttctagtagcatctagctcataataattgtttttattaaaattcctgagttctagaggctactgtccaacagagaagaacactactgagtgtggttttgcacataggcacccgggttccctgcagcagggatacatgtgccctatgctcaatatggctcctacgttgtgacccttagtgctcgctgtaagtgaacacttgctacattttttagtaagtcatttcctgaaactatccattgcatctgacaactcatgaaagattaccaaaatgcagtttagagcataataactataattgggcttgcatttgaagttttaaagattgcaaaaggggaataaaaattaagaagaagttttaatttaagccaaagtcagatattaaaagtccattgtagaattctggtaaataatttttccaatggaaggccaaaattcaatgcatctggaagattcatatttatatgaaaataagctttgacttccctggttcccttaattcccacactcaattcacctgtttacagctacaattcttttcatgtgtgtctggcttatgttttcaataatactgcaagttctaaggcggtttggctggtgccttgcacctttttacatctctcatacagaatggtacacataggtgacgtccaggaaatttacatgttgattgaaaagcatctctctcagctcccttgaaaaattgcttttttctagggtttccctatcaattagaggcaggacaaaaatgcattcaggacagttatatccattgttctgaactttttttttttttttttttttttttttgagacggagttttgctcttgttgccccggctagagtgcaacggtgcgatctcggctcactgtaacctccacctcccaggttcaagcgattctcctgcctcagcctcccgagtagctaggattacaggcatgtgccaccacgcccagctaatttttgtatttttagtagagacagggtttcaccatgttggtcaggcttgtctccaactcctgacctcagatgatccgcctgcctcagcctcccaaacggctgggattacaggcgtgagccaccgcgcctgacctgttctgaacttctatatgattattttcttaaatctcctatttatatttcagcgtaatggtttcatggtttgtatttgacctttgttttatgtatgacacattactttttattttacttaagaaaacttagtgacttgtccagtggtatttcctttgctagtttattcgtttaacactgaacacataacatgtggtagggatttgttatatttttagaataaaaagggcagaaaaggtgtggtccctgccttcaagaagctcagtggttccaaactgtagaataaagtagttccaaaaccagcataagtctatgattgttttcaatatgtttaaaaatcttaaggctaatcaataaccaaaggctgcattggtgaagtgaaacatgccattgcacttgtttcccttttatctagatatatcaacataatgtataatatttgcttttgcaaggagaggagaagctctgaccattatttatatatgcattcagtaataaagattgtaataccaattgtttctgcagtcgacaaagatcctttagagcaggtgctcttctcaaggcaggaaagaatacaggaagaacgttggtgctgacagggtggagccagggggctgacggcaaacgctcagttaagaggacatgctccttatcggactagcccagtgcacttgttttttaaaagtatagattagggatatttgtattcactttacagtagtggtgttgattgagacacgcaaatattaggcacttaataacaagaatgtatttttattaatagtggtaatgattactcatgattctatacttaatcctacctggtataaaagccctgtgcataacgacatggacattttaatagttttgtctattagtgggcaaagagaaactgaaaagccagtggtcttcagaagataaaaaagttgtctcttgcaggcactgagtaataacaggcaccttttttgggacacgtcactcagaaagtatagcaatgctcattcggtaatgtaattctgctgtgttaagctatattttcttacatttgttttatttcttcatattttctttctctgggaagtttattttgaaagctgctccttcagcaagtctcaccaccataacttaatttacttcatcgaataaaacaaaagacctaacgtgttatatcgtatgttttcagaactgactatagtcttcaacatataagtggttaaaatgttttcgacatatgttcaacattagtagcaagtaatcggctagtttcatacagttatcatcattgcattacagataacagttaacagctgtgctgaatagaaggtggaagagtaacagtagcaaaacatcttaaagcaggaatactttacctgaaagggctatcagctggcgatgtgatggtggcagaggaaagactcatagaccatgatcagggatgagtggaggggccacgacgcaggtgcaggtgatgtgcataacagccttaaagagtccacagctggcaagtgcctccgtggagtctaagtgagtggacaggtaggctcttcccaagcctatggatgcggtccaccgaggaaagccatagctgtgaaccccaaaccaggcttttgtgcatgcaggacaaaaagcacctgtaagttccacattcctattttacacttgcaaacactgaagacttttggtctccgggtctgtgttgtagagttgtattgaggagacgcgcaggaggttagttgttcctcagaatagctagtactaagaattgaaagatatacattctagcatgcaaacatcaactttactaagatgatttttaacgatatttaattcaaaaggtctaaatctgttgtttatgcttttctgtggaaggtttttaaaattcgaggctattaaactttgtatagttattaccaaaattgtacttatctttgagttcatgagaagtgagaattctgaaatctgatgtcttagtttcatgcccaaccatgtgtgaggaacaagttcttcttaagtgaagtattaaacagaaaataactatgttatttcatctcttgggccgatcgttgttcattttagtggtccattcttgtggaaaaagaaattgctcccagagccccagaaaaaatcacagttgttagctgagttaggatttttcagtgcaaatgtcattctaaatgtctagcaactttttttcagaactagaaatacaaagtagaatgtgtaaagtgttgagctaactgtgatgtgatactttgacataattatgaaatatatttgcttggttgtatgcattcattgcatatgctatcttatttcttgtcccttctgtctgctataaacaaatagatgaatgaatgaatgactagataattgggagactgaagttaggtggttttattaaaaggaagtttgcatattcagagtgactcatgacagagcttccttcttggaacctgatgaagggaaagaaggatggttttagttacgacacacagcttttgaagaagtcgtggagtttgaggtgggaaactgactcagaggagtaaaataccaggtcagaaatacaaagcagacaggcaaaaaaccaattccaaaaagttatactggcaaaaccacaagtctgaatgttaaggaggcaaaataggtagaagtaattgtttaaaaaaattatgaattgctgaatttgtcaaatttgtctttcataaaataagtttatgtaacctttagagcttaagttctgggcagtagaacaaaagattgctactggagatagagcaagagaaacaagaagtgtcacattcacatggaagcacttggtttgggagccagtgtctgtcggttccgaccaaactctgggtgggaggtctgcttccttgttagtcttcatttgagccgatggcatgaaacaagggaggcttgggcaagtgtcctctgcaaataaaggtctcttataaatgcttctcatcccacctccgcgtctgcaatagagctattgttttgcaatagcatgtttccatctgccaaagcacaaactgattgtttatgaatatatcctcaacatgcacccccacccaggtgtaagcaggtaaaagcggagtaaatgctttgccccatcaagggaaagttatgagacagaatcacatttgtttgaagcatcttcatcagggcagtttcttgtttcccttccctctggtttgagctatgcttaattaccatagaacaaatatcaggttgcaatcttctatttatttttctatcttcaataattgattgcatagtctttgaggcaaagctaccctgttaattttatttccatgaacgcttacgttagcacagtgactgacgtctcctgacactttgacactacttgctcagtcaataagtgaataaaacccagaacgaaaccctaaggagatctcaaaggattgaagagcggggagaacactgcacacaagctaacttccacaagtagcagaaagctatatttcccccttgctttaaaaaaaagttttactgtttttctttattctcactaatttttattaccggcaaatccactatgtcccttcctggtcacccattcacactgccttgcctgcagttagctcctgggcccatagaacagagagaatggagctgctgccccctgctggcttcacaggcaatgcctcagtgagcattgctagattgtgtctatatctgtcttttagtttatttttatttttttttaattttggggttcacgttaggtgtatatatttatggggtacatgaaatgttttgatataggcatgctatatcaaataagtgcatcatggggaacgatatatccatcccagccggcatttatcctttgagttacaaacaatgtagttatactctttgttatttttaaatgtacggttattactgactatagtcaccgtattgtgatatcaaatagtagattttatttattctaacttttttttgtacctgttaactatccctacctccccagcaactccctactgtccttcccagcctctggtaaccatccttgtattctctatgttcatgagcttaattgttttgatttttagattccacagataagaaccaaagctgcaaaaagctatacttttgtgtttgcctttctgtgcctggcttattttagttaacacaatgatctccagttgcatccatgttgttgcaaatgatagaatctcattctttttatggttgaatagtactccatggtgtctatgtaccacattttctttatcatctgttgatggacacttaggttgcttccaaatctctgctattgtaaacagtgcagcagcaaacctagaagtgcagattatctcttgatgtgtagatttccttttttggggggtatatgcccaactagatgatatgatagctttacattcttcccaatagtatgtaatggtttccttttctccccatcctcacccgcatgtgttagtgtcttttcaatttagacataacattatttggatctattagaaatcagattacttagtgaagccctcattaattaccacttctttctgtcccagagccctgtcttatgggtggtctcttaacaacaacaacaacatcaaggccagagccctgtcttctgggtggtctcttaacaacaaaaaaaggccatctgttctacagagtttcctttcaacagccatggaggtttcccattagaactctacacagcagcaaccatagcctcagacagagtgagaggtggctctaagctttgggctcatttctttggagacagcgtctacttttttttttcttggctgaaactaacacagggcccgattacatcagtgtgtccacacaggagtcaagactcctgtggagacatgtactttgatatctgggggtttagaccttgtgacttctttgctccatgatagaaaggtggaagcgacgagatgaataaaaaactaaaatttcaaagcatcattaagtactgactgccttttaagagtaagaacaaaagcagagtatacagcttgtactgcatactaatcaaaacttattcataaagttcaagttcaaacctctctgtgtctaaatattttcattatttattacaattagcatatgcatgattcatgttagctgtctgccgtattcaagagcgccagtcctatggaacagcacttaaggagaatttggacaaatctcttccccctggctggtgataacaatcccagctgaggcgtcagtgtcagtcagcaagatgtggcatggctccacatagaagtcttcataagacatggaaatggtgcactgctaaagtgtgttaattaacatcttaggggaagaaggtagtgaaaattagtcttcacgttataatttgaaaaatgagtcatggtagttaattaacctatctaatacctcaaggtagatgaatgcctgaatcaattcacaattaacgatttaaataaccccagttttaaagtagccttataaaacctatatttcaaattggaaagctgaagctctgacagttgatcttttcttgcattacttgtgtatgtccaatattctaaactgtgaactcgtttgaaggcagaaaccatctctatttatttttcacatcctagttagaatctggtaggatattttacatttagaaggtacctaattaattctcaaaatataaattaaatttccctcctttgtacttataatctgtacttacatttccaaaaagagaaaaagaggcagcatttaaatcaaccaacacttagtgaccatagtagttggcttgatgtacaagtaattccatgtctggatacttgatgagatataacactgttgagaattactcacttttgcagctgcagtacctagcatggtgtctaccacctgagagagattgggtaaatgttgaactaaaatatactgaccacaatcattgtggcaaataaaagaaaaatgttacatgcaaactcaccgatgtctttcatttcatcacctgagcaattcaggttatgcatatgcaaaatgtagataaaatttgtgttaggataattccaaaatctctgtgtgctaacttaaccaccctcaggttgctgactgtccactggatttgcgtacctcattgtttcacaggcatctcaaattcaacataagaatccactgtctctccctttagttccaaaataactagttctacctcttgtctcttaatgtttgctaatggtgaaatcatatgctcagcttcccaaattactaacctcagaatctttctggaatattacctctttgcattgaccctcatggtcaacctgtctccactcttttcaaacgtaatctccgacgatgtttgtattgtaacctctccttagtatccccactgccactgttgcaattcaatcatttatctcctctctgacgctaataaataaatacctcttgattgtccttcgcttcatttccaaccttctcgggtccatcttgctcactgggtctagagttgccgccttaataataaatgattcccaggtttctaatatctatagggcagtgaagaaacgcttttgtttgttatgtgagaaatgtcatcatttgttcccccaatactgtgatttttttttctttctttctttctttctttctttctttcttttttttttttttttttttttttgagatggagtctggccctgtcgcccaggctggagtgcagtggcgccatctcagatcactgcaagctccgcctcccgggtttccgcctttctcctgcctcagcctcccaagtagctgggattacaggcgcccaccaccacgcccggctaatttttttgtgtttttagtagagacggggtttcaccgtgttagccaggatggtctcgatctcctgatgtcgtgatccgcccgcctcggcctcccaaagtgctgggattacaggagtgagccaccgcacctggcctttttttttccttttaattcattcttctttttcactagctagctacttcctctgccattctttatcctggaccacgttgttctcattctttttgaactcgtattacttcgttcttcccttctattggttgttttcagaaagctcacccttatcttcatgtgttgatcccttacaactcagctcgaacttcactgcctgcctaaaagttgcgtgaatacatgggcatgtgcccactcaatcctctttgcttttttttcataatattgttaggacttagagctatattgcttatatctctcctaacgtatatcttcctacagatgatgcgttcttgccatcaagtaaatcttacctgtttttctgttcccagtatgtaacgtgtagcacataaatgattttcggtagatacttgatgtcctaccttctaaacatatttttcttccctctccttaccacgttcaaatatgtattgtcttctaaaattacagatttaaacctgacataacacatccttgttttatctgtatgaattaggtgtttaaaaactttcaattatgtaacaagaaacaaaaggaattcatttgaatatctctaggagtccaatagtaaaattacattgctaatggtggcacctactggccacgtacgatattgcatcccgggtctatttttataaaaatggggtcctgtgagagactcttcaaggtgctaagatagtgaagactagtcaggggccgctgtggaatcaaggaggtgggtggtgaacaccaatccaagtgacatgtacggtttgttatttacaaccttcactagagtacagagctagccaacgtagccaacttgcaattgattggaagtctcccttttagtcagctgatctatccttccatgggatcatatcctaagataacgaatagaagtcaatgtaaatcaggagtttctttaaataggtttgaagagtcaccctccttccactagatattgatccagctcttgctgtgcaggcaacactctacgtagtgttgtctactctgttgcagagatacagtatcagcggagaaagtccttgctttcaaaaatcgtgtgctccatttggaatatcacagtttattataatgacttatctacttaacagcaactgttagtgggtgatagggtttggctctgtgtccccacccaaatttcatgttgaattgtaatccccaatgctgaggtagggtcctagtgagaggtgattggatcatgggggcagattttcctcttgctgttctcatgacagtgagttctcttgagagctggttgtctgaaagtgtgtagcacttcctccttcaccattgtcttctgctgccacatgaagacatgcttgcttcccattcgcccttctgccatggttgtaagtttcctgaagcctcccagccatgctcctgaacagcctgtggaattgtgagtcagttaatccacttttctttataaattacccagtctcacatagttttttttatagcagtgtgagaatggactaatacagtggatatcaattttactctcagaatgacgaataaatgaaaactcaaatacagatttaaatccaagttagaattggcaagtggtatatactttccgcataagatgttctaatgtaagctattgaagtgatgaaggtcggtccatttattttaaatcagaaatggtgcccagggcaggccaggaatttccttgatgaaatcagacaagagcttttagaatcaagggtactaaacttagagtgcttgagctagttcggagctttctgttatctagcagttctcatacgccctcacacacatgcacctgcttttatcacagggtatgagatgactgaccctgaggatgaatgtctcggctctctgggtccactttttaatggttctaagagttgatccaatcagtaatctctctccactttaatttcttaacaattaaatggaaatctttgttacatttacctgagagttttctttgtgagaaatatgagaatatatatttaaagcatttagcagatagatttgacacttactataatccctaagtgtcagctagtaataattttaaccacaagcagacaaccaatcatttctgtaaaaccttgcatacctcatgcctccatgttttagctcacacagttccttctgcctagagaagtccccttacttatttacatgaacaatttgtaattttttccctggccacagcgcctcttctccaaagtcttcctgatgctcttagtagatgtcaatgtccactgtatctttcagtcatgtgtcaagttcattgccactgtagcataccactcaggcattgcatctccgtaagaatctgtccatctcctcatgtgcgctaaggactgaacatctcaggaagaactagaatcacaaacttccattactggctaatgtcctcatccaaatcccagcctctcacctcccaaaccctcccacactcagggcgttccatgcatgtttgctgatgtacgtgagtgtaattaaaataccaggaaaacagagatacatgccagttcagtgaacagtacacaaaaggttcccgaagagaagggtagatagaagctttggttggttctggtttgattgtaaggtaacatgtggcattgcttggaggaagctccttttgaaagtgactatgtgtgcagtgggaatttggagttcccctcactttttctcccagacaaaaattttaaatctcgaaggtcccagctttcaggggagtgtgtctgcttgtgtcagctgcttcctcttcatcctcatccttgcaccttctggatgtggcacacactgtgctttgtctttgagtgtcaggggagggggtgggagatgctggtccctgaaggggacctgctgcagtcatctccctaaagttgtaggaattggactagaaccccaaggccaggtacaggcatgtgtttgtgaatgtctagtaaatatttattgaccatttcattgaagtatgaacaaaaatcagagtatcatcattccatgacctttccaaagcgaaagaaagagtgtcaccaggtggctgtggagtcaacaaaccttggcatgacattttgtaagagttccttaaacccttggagacacattatcttctgatattaaaaaaaaatatgtaccatgcaatgagcagcatcttgacaaaactctaagatgatagtgtaaaatgcttggcacatagaatgtactccataatgcatatggatatttgtagttattcaataaatgacggcagttttgtcctttgtcattgttttattcataagaataaggatgttaattataaggtattgcagtaattgctgaagcactaggaagaagatgtgatccaaagtaaagactcccagtggagcactaatttcccagtcaaacctacaatatgctcttgtaattctccctctttttgtcaggtgtggaaaatgaaaggacatctgccaatagttgcatttttcagattctagattctttgtccattgaataacggatgatttaacgaagttttacagtttcttttttcctaaggcataggtaaaatggaaaaaacatccctcccactttgagttcgcatggttggagttgaagtaaagggtagatcatcctgttattcaccaagtgctttgtgcagcccttaaaatgaagggcctctaaatgcctcgttgattagctacctttttcttcaggcagcagataatttctgggtaacataaggaagttcactgaaagttcattagactctattctagaggaatcatcttgattttcttttttcccagaatttcttcacttagctgatttctctttctttccctgctcattccacattaacctcacagtaggctgcacttgactctggaatgacctatgcttatatttcttaaagtccaatggttccaattaagcgaagatacaatgacacagggttgcaatacagtgttgccattggcattagttggcatgcattaagtggatttttctgtgacctcttagcaataaaaaactaccacgatcaagtcatagtttgttctatgtatctatgtgtttgtcatctatctaatttgtaatggcttatgatgtctcctcttgacacacaaactgcaatctcctggtaatccattgtcaggcagtagcttcttgattcttctatgatgacaatctagcaaaaagacagatcctaagtcattatctgaaacggtaagtgttcctccaaacatacaagttcagttattgtcaattattttacagataagtgttattttttcacagccatcaattatctctaatgtgtcaaatcttggtagatgctggcagtgagaaatgtaggaaaaagaaaggaaatagaaacctcatggttcctttctttaccaagcttgaattcatttgggtgttgtggcatagggttgaggtgaggctgaaaattagaagcactttgtctgtttcacaatcccattgctgtaaacaagactcttcttgtactgtcagatttctcaggagtgattcagggcctttgcagaactgagtttccaagaatgtagctcttcagtacctgggtatccctggcctaggcaggacgtgcacaggtataagtccttgtgattagtgccttagagaaggacaggcagttcatcacgagagcacggaaagacaagctgtccgatatgtttgtaagcaaaatttttgtgtgtgttttctttctacatcagaaggcctctaaacagggcaacggtggcattacctataaggactcattcaaagtaaactttgtaccactctgaccagccccttgtccccaaggtaaagcgatcactgactgcttcttgctgttctttagaccattaactaggtgggtgtgaaacagctacataaatgtgagtttctttttttttttttttttttgagacagggtctcactctgccatccaagctggagtgcagaggtgcaaagatgtcactgaagctcccacatcctggatttaagcgatcccccctcctcagcctcctgagtacttgggaccacaggcatgaccactgtgcccagctaattgtgtaaattttctataaagatgaggttgccatgttgcccagactgctcttgaactcctgggctcaagagatcctcctgcctcagcctggtaaagtgctgagattacaggtattagccactgcacctggccttaaatgttaatttctactgctgagttgagatgttcagcagtaaaaggtatgactaagtcatctttgtatctctacgtttttagcttttagcagagtgttgcccagtatagacacgtaatgtaggttaaatgaaaacatagattaatataatggtttgatgggataaagcttatgactaaatattgtcaaactctaactgaaaaaatattaaaatggttaatgttttaaaattctcatctaaacaacttgagcagtctttattagaagattgaaaggagaaattacattggctgtggaattgcaacaggcaggatcaatcataaaccaaaaggactgaaacagatattttaaccattagccacctctttgttaaatgcaaaatgttagtggagaaaggtaacctattaagttatcattacttttcaatatcataatgtatctctaataataataattagtgcagttttgataaataatcatgtgtcaggttactattacaggaattactagctctatggtttggggatggttaattaacctttatgaacacattaagtactgggacgaggatgtggaacgcatatcatgattattctgatgaaggttctgtgggcagtattgagctacaatctgcagttcttcacaacagtacttctgggctcatctgattttaagggtaaagaaactgaggcatgaggagcctaggtaatgtacctccaaatgataaaagtagtagcgttaggattttaagtcatgccaggttgacttttacacacctgggctctggtcaatgtatattgccaaccccatgccgagtaacgttctcagttttaaagaaagggattccagatgagaggttttgatgaaaaggtggtaggcacaacagtctggagtttgtgaaagagcacaggaaggcacaggatggctcaggcaataaaggaccaataggtgctttcggatcttaccccaagacactcagaaaacagcagaagctccctgaatttggctgagagaagattatctgtcaactcccctgctttgcgtggttatgtcatcaaataactacagcaaagtcattgtggtcttccatattcaggtcaacaattgggcttatgctaccttattttcttgtggctataagaaaagtcagcacatttgttgacataattttcattgaaggtaacaaaagtactaagtgcatggaacatatcttttcatataatattggcttagcatgtagaatattaagtgacaatagtgctgctttgaaaacacttaaatgagctctgtatttgtgggatggaagtgaatttcctcgtgggataagttgtagtgatggaaaatcaactttgtatacctttgtcaaaaaagactgaagaatattggactcatgtaaaaaaaaatcccactacgcttcttttgattgtagctggcttaaatatataacatgcattttgcattataaagtttattatgtgatggttaaaattctaagttttagtcagcatacttttgaaactcatgaatgaatattggatttgacatttttcattgtatttcaagcagttgcttgaggacgagaaagattaaaatggtaaagggcaagtaaactaagaatttaaacaggctgtacctgtagattacagtaaaaattttccaggggtttaagcaggagctgaatttcaatctttaatgaaatcctttgggggaaaataacagtggagtaaaacacattctttttagatctacagataattaaaacctactcaatggatgtttttcactaaatcagagtaagcatttcgagaagctgggaattcctaaagacttacctattcaatctttctgagacacaagctcctcaaagaaaatgcaggctgtattttcattgataaacaaagccttgtttgaaaaagtgttcccaagaaacttggtggaaaattttagaatattttgaaaaatattcagttcatcttaagtgcactttgttttgacttgctgaagaggtttctgcaaagaagagagtttctgtcgagcttttctcttcatccagacagctttgaagtcgaggaaggtaactcgagcagccgctgggctttgtgtgtcttagtgtgctcttctagccttagggttaagataaaatgaaaaccattctggtctttctgcttgaaacatgagtaatgaagtaaatattagtccttaaattcatttggattacaaaaatacctgtgaaaaataataaaagcagatacattctgaggttttcagttatattgcatggcaacgaaaactttgctagtatacctgttttctttgttttaattattctagctgattgattctgcttcacacctgaggacaagggcattgccagaacatggacttaatttttttccctgttcttagtctgttagccatccatggatacaaacataaatgtggtccatggaagataggcaagcaatttgatttcttaccgtcgtattcaacgtgtagtgagcacaaacttacactcaagggtgagtagtaagctggcactagataagtgctcagattttgaggcaagttaaataatcactctaaatctagtttttcttatccgtcagctggcactaataacataaatgttatagagtcgtaagatttggtaaaagtacattaagcctgtacttccatatagcagagggagctcctatgtttaaaacagaactgtctctccattgggttatggggcatgagggtcacgaaaggcagagcgcagggaaaggagcttagaatgagtgggaaggaaagctacacatgagagtgaggtgcaagtgcctgcagcaatttctcccaagttatctcctttttgctcttccatcagttgtttaaggtggacatcccaactacgctaacttggtcactacgcattatagacacgtaacaaaattttcatgtaccccatgaatttgtataaataaataaaaacaacataaagcaaaatcaaagaaactaaaaatatccctgcttctgtgactagcttatttcagttagcgcaatgccctccaggctcatccatgctgttgcatatgcaggattgcgtcttttaaaaagtggaaaaagctgtaattatatatgtattatatgtatatatacacacacacacatatatacacacatacatatacgtatgtgtgtatatgtcacattttctttatatgttcatctgtcaatggatatttaggttgctttcatgtcttgacaattgtgaataaggcaacaatgaacactggggtactcatgtctctacaagatcctgatttgaattctgttggatatataccgagaactgacatttctgaatcatgtggtaattcaatttttaattttttgaggaaactccatattgttttccacaatggctgtgctgtttcatgttcaatggacagtgaaaaagggttctaatttctccacatcctccccaacacttgttctttttttaaaaaaaaattagtcatcctcaaagatgtaaggtgatagctgcctgttttttgatctgcattttcttggttcgcagtgatgttcagcaccttttcatgtgcttattggacaattgtatctcttcagagaagtgtcttttgcccatttcttaattggattgtgggatttcttttttttttcttttttttttgcatttgatttgtagaagcttcatgtatatctctatatctcagatattaaccccttaccagataaatggtttgcaaatcttttctcccattctgtaggttgccttttcactggattgattgttttctttgctgtgcagaagctttttagtttgagggagtctcacatgtctctttttcttttcttttctgtgctttttgatcccacttgtatgaagtatctaagacagccacacacatataagcagagagtagaattgtgtttaccaggggccaggggaaggaaaaatcgggcgatctttcaagaggtataaagtttcaatcatgcaaactgagtaagttctagaaaactgctggtctacactgtgcctagagtcaccatcactgcattatatgctgaataactggtgaagcgaataaatctcaaggtcagtgttcttaccgcacacaagaaaatatctgtgcaggataaaacactgacagctaatagttgtttatatccttgagtggggtgattgtgtcatgggtgtatgcatatttcaaatgcctccaagtatgtatattaaacgtgcagtattttgaatattgattacatctcttcaaaaatgtcagataagtcacatttatcccacttcttcaggtagaaaatgttgaaatctaaaattaccttgatttgtgttgttcatcaagttataaatgtatgcagtatttaaaatgggagagaataaactgcagagaagcttgacttcaaaaaggataaaaacctaagtgtcataaacatggcagtgcattcaggttcgctcactttccaaagagattctttgattgcttctactttgattcccgagaaatgtcttggctttacgttagcatttgtgtagcagtaacagcccattaccctgtggccacgttctattacaatgacatttcacttggagatacagattgtttcttaaatataggctatatacctggtcatttcctccgagtacattaaaatactaattattactcttgttagcttttgtctttgagtgacaagttccagcagtgttattccaagtaattccatgatgtcagcagttatttcagtggatagaaatgtgtacgcaaaaattgtcactttcgttatgagattccttctgttgggtgtgttcgcacacacatacacagacctcatcaactaattcctttgaaattgaaagactgtcttgtttgagactgtttccgtggtgtaattattaatagaactttcttgtattcccaaaatattttaattgggactactctgtttaaaaaccattctatttctttaaacaagaaaaatagtcttctttaattatacaatttttctacccggaaccacatgttagcttagaggtctcagggacttaatcacttttcacattaaattaaaactctgcatatcattcagactttcatccactatctacctcccaaccaaataacacaaagtattatttcaattgatacgtacccaagaaaaacttgtgtatttcatgtattttcttgttgagatctctagccctctttcttggctaatctataacattacatgttataggtagagaatgaattaaactactttgtccaaaaatatatataggcatcaattgtttttccccatttccttacatgtacgtgtgagagggagagtgtgtgtgtgtgtgtgtgtgtgtgtgtggatatttatttgtgtatgtgcaagtatgtgtgcatgtgtgggtgcatggatgtttgtgtgtgcatgtatgtgtgtgtccatgattgtatatgtgtgtgtccatgcgtgggtgtgtatgtgtgcacttagatttgtgctatattctctggttagaatgctctttcctctttcttctcttgttaagagtatttctctctcaaagttcaatattaagccttccttttattctctcaagcctcatttatcttcaacctctgtgagctttctttttctcccctactcaccactccatgagacacttgtgcacacactgccaccaccaccacactggctaagtttttcaactcatttcacttctgtagtatctgtattgcattatattaattctcaccatagagaattacttgtttatatgtcagtgttgtgattattgctattctttctaaaggctatgtgtagtagggggtcgatgtatgtttgagtgggcaaatgcccatctttgctgtgtgtactgggctcatatactacgagggcttggactaagtgagccttcagtatagatgaggtacattgcaagtgagtttatatgcattattctatggaatcctcggttgccctaagtaccccattttaccagtgagtgaggaaactaaggttatgtagctgaaaagtaagaaaagttaatgaactactttgattttttttcaaagtcatacttgtagagtgtaattgtaattgtaatacattttaaaaactaagtcatcacagaactaaaatctggaaaaaataattaattgtttttaattccaagagtttcaacattggaaaacacaagcataagaattaggcaattaaagagtttagacatttggattaaacctaataagaacctaggcttaaacagatctgacaggaaccagcagttgtgacgattgctgcataaagcatccagtagcttcagtttgacaccagtatattcatgctgtatcaagacatcacttaaaataaatttagtggacagagtggcaaaaatgcatttcacagacacagtgatggaatgagaactgcaaattgtgaaatacaaataattactggatttcccaaatggttgctagatgggatcatcagaggcaaagtccgaataaattatcaaaacaaaatattagtcacagaaagtacacagtgcacttctcacattaacataacatattatgaaaaagacaatctgacggagaaaattacagaagggacaaaatacatatggtttcatcaaaccaagaaatattttctaaaaagatttgattgccatacccagaggttaaaaacagtattatatataaaaatagtgaatcattcttatgaaagcttacatataggagagacaacattgtatatggctaattatattttaaataaatactgtgaacaaagtatctcaagtatctttttttgttttctatgaattgctaaaaatgtaaaaattgctaaaaattgctaaaaatataaaaatgtaaaaatttttcctgcacatagtttaagtcacaggtgggataactgcctagttatcctgtggcccaggtaaatgagaaacatctccatcgggttacaatccacgtaaactgacagtttacattttttggaatcctcttaaaggcatatagattatctttttaaaaaaatcatcaaactaggccagttgaggtcaaataaagcaatgaacacatttttgtcctctctaaacataaacctagatttcagtaacctgcagtgggcaaggcttcagtggtatctggtgtcctaagacagcaagacccataatcggatcctctagttagcaagtggtacggtgaaagtaagttgcaaacccccacgaatcacacacaattttattttactttgctggaatgcacagtcacagaagtaaattcagaggcttataacatttaactttcaaaaagggaagataggaagcatgtgaatgttctggtaatttttttactgaacccgaaaagaaaggaagagaatagaaaagggaaagagggaatgtaataattcccatagtagtgatgacatcagaagtcattgcattacagaggaactttattttacgtagtattctctgagaagctttattcgattagattatttaaaaatacctgaagcaggcaagcaaatgtgattacacacattttacagctgggctagagcagaagcgtgtggaggcagtggggacaggctcagcttttctgatctgagtttgttggcttttatttagttacacgtacccaattgctagagagttgtaacatcaatatagtgttaggaaaggtaacatcacttataacacaagaacatccattttgcttggaattcaaccaaaatgaatagggctctttcttcaaaggaatcagagtcatcatttcctttcaaaattcccattaggtgaagtaaacttccctatttttctgaatatgaagggctgcatgagactctgtaggaagagccctgattactaggggatttcaatgatgctttaagttttctttgtgttgtactgtaagatatttcataattcatgaagaatgtgcatgaaatatgagaaaagtgcgttccctgtactgtcttactgcgtagtatgagatttttaccttaattttctatcaaaacactgaagaagaaaaatctaggtttgctttatggggataaacgcacctctttggagctatttaactatttggataaagtttctctgactaacggattcttaaatggattggattatactggcacatgttcccagcctattcatatttgcctcaatttgaactggagtctgcgtaataatcctttataattgtaagaatgtttttccttccatgacgtgacctgaatgtcacagtgacgtgattacagagaagagaggatctgtgactcagagaagtttcggcgtcttgcctgatacaaccgagatcttaagtatcaatctggtatctttttacacttaaggaagatctctttcccctccacattgttcttcttggtgtggagcaatctaagccgtgcgatctgagacattctaatgactacgtgcagattgtgtctcttaccatttttgagcactacgaaagtaaagcttgaggaaagatggaagcaacatgaagatatacacatctgcaagttaagagaaaaatctcaaatcacctccatataaaagtagtaacaacaattattcttgcattagtatttagcttgcaacaagtattacagttactgtcttcatcttattgtcttgtttcatattaataaggtgggaaaaacaggaataaatgtctttatgcctgaatgcaaagttagatccttattagtccatgagctatgcagccttgttaaggaaatgatacagccatttgaatgatggcaaagcacaggcttgaatcattctgaatttttcaactcaaaattacttcagtgatttcagaaagctatcccgtttgttttcacgcatttctttgctcactttttttcttcacttggatcattcccttattattcttctgtctttctgagaggaggttggccatttccttatggctctttggtaggctttttgttaacattgacaggaaaaccagtgcagaaatggctactatttaatcttgctctcgtgtatattttaattgccaagcaagctctattaaaatgcttaaaaatcatagaagtgcatatgagtcattcttacctttttataatgcttctgaatactcaggcttctatggcgcactaactgtgcccagccctgtgttcctggcagtctgtagtgtttattttttgtgaagtcgggtcaccgctacaattcaataatgcatatcattctctgtccaggccaagagaggatgctgcctaaatgcagcttgttgagtagctctcccttcacagagaggtggtgcaagaattctagcctctgtcccagctcagatttgccttaggtggctttcttggaccagaggtacaaggcaggtggatagactgctgtggttcaggaagagaagcatggaattggagacctacatgttgatgaatagaacaattacataggtttaccaattacaataaaaccaattagttgattgataagtagatatttcaaaaattacttatgataacataaatggttctccccacccccaaagtccacagggcagatagttcttcccttagagaagggttccctacactcgtttgctcttctggttggaggaatggaacctccacacccaaacagccccacccttagcattgactcctgtttcatggaaaagcagccaggtccctctctacatgagcattttccgttcaatggttttatctgtaagaactctgtagaaacactgggacagaatttacaaaagactgagacaggggtgacaacagatgatatttgttgatggagtatttgatattccaatcttaaaaggagaaaatttgaaaatgcttaacaagatacacacattttacttatgagacagtcatcaaaatttgagattctaacacaagggaaaataaaatcagaattaatatagggtcctatatagcatatatgtattatgttggatgtcaatttggcaataatatttctataagtcagttgggaaattttatttgctctatgaagcttgcagaatgacataaaatgaaacaaatttgagaggcctatttccatgtcaagtaaatggacacatattccctatgtgaatatgagctatgttgtctaatacaattggtaaatcatatgaacaagtttttaatgatgaggttttgtttttgttaattgtaaaatgccaaatactagttaatattgtaataattgttattattatttcttctgtcaaaaaaattgaatgtgtgttccttgagagtggaaggacaccagtagagcagaaggacgcatgagctgcctgctgctgttgcttttcgatagaatagcagcaagtgacatgcaagtgctgttgttgctgagctgctcttccaggtattctgtgtcttccaagccatttattcctcaccagccatgaaacatagctaatattttttttcattttgcaaatgaagaaatcaagtcacagttttaatataaattacaggtcttggaatcagaaacccatttccaaaccttgttctcaccacttaaactgaactttctttagtaaacagtttaacttttcttatctgtgaagtgggaaaaatgataatgcataattccatggtgagtctctaatgaaatgaaaatacttttgttttacaaagtaccaagcgatgtgtagctattataatcagactatgagttatgtttgcatttgcactttctgtgctacatgatgattgttttttcatctaaatgtttattaatttattcatacctttgccctttctctaaagatattatttccttttactggcactttccctcaagggtgtgacaagtggcctgacacatgatttatcagggaaatatatgtgcacatgtgtgtgtgtctctggattcatgcctatataatattattcttaatacgtatgtatttaatgtatgctaaactaaatcaaaattgttgctgaggttgaatttaagtttggatttactgagctctcttgtaatcagaatgttaagaaaagaaaacgatgttatattgttcaaggggagctttccatggcacttattgaaggaacattaaactgtggcaggcaatgctcaaatttatacttttgtaatctagctttggtcaatttcatcgagcttttctagactaaatcggggtgacctacgagaaaatcgttacaaagaatgatttttctattgctatacattttaaaacatttgctcaggagaactcatggtgatatgatatattgagaatatataaatctcatttgtcacataaattatgcaattttacgagtaggcttcccgacttttagttctgtattacatgtgttcagttcaatgcatcctcctgagttggttaccttgcaattcatatataaaaagtgctggtcactgtgacgctgactgaaccttattataatgatgcataatacctcaatgtgaaatttaactttttaactgtacctaatgctagggtagacagattaaaatataatgtttgagcagataatatttgttgctgattgttctaatgttctttgctgaaactctatcatatcattaactattttcaattttcaccaaatgatcctgtagttacaagctccctgcacttatatatcactcatgatggtgtatttctaatcacattgagagtacctactcagcgtgatagctgcattatattaattcgactacaaacaaaattatgcaatttaaagtattgattgtgatagcattatcttttgatacatctgccctgtaataccattgattttatgcatgttattaaattgtttcctttgattcaaaaattgtattttgattgcatgagcaaagtcaaaatgtgggaaattataattttactttgaaaaggaaaccatgcagtagtgtcttggccttttgcctgtggctggaataagaactggatcattggacgtgccctttgggcctcctccctagagaaggtgcgtcttgctcctacttctatgaaaacacttgctgtgctgtgccagagacttgacgtaggttgccaagcaggcctcatttttttaatttgttatagatgttttatcttagcatattaaaaatgtgagcttgaagaaaataatagccaccttaatgtatagcttgattgggcaggcctggcacacatattagtgggaaaatcttcatattttttcactaactgcaaatctaggttaaaatcatatacatataggagcacagtaatatttatacatgagtatagtgtgtatacatgtgtgtgtatttatgtaaatattatgatatgtatttatatacagatacatggaggcatgtatatacacataataaagttgtatatacatggtctagttcttcatatatgtctataaatcttaacacgcatttccctgccaggagcctctgagccctctgctcttatctgtgtttggtgcagttttctttactgttaaatggtagctgtccttcaatgcaattccctttctggcagtagatgggagtgattgttatgctccaaacctcagagggcatgtgactgtttctgagacccccatatgacttgcttcctgtataccattaattgccaagtctctcagttctggctctgtgacatctctcccatcttttcctgttccttcatccccatcctcagtcctagatgagtcctgcaacagcctcctagttgattgatttttgcatctggaaatcacttctttgtagaagtttaagtcctgctttctgatgagctttcaccagtgggaattgtagagccatacggtcgggaacaggtgttcacatggttcgcctggttcctcgactgtgcttgacactcagaaggctcttgattaaaatctgtgttgaatgaaaatgagaaagaaaccgtgatttggctgcgcatggtggctcacacctgtaatcccaacattttgggagcctgaggagggtggatcacttgaggtcaggagtttgggacgagcctggccaacatggtgaaccgccctcactccaccaccccacagtgcccccagccccccatctcccgctttgtactaaagattcaaaaattacccaggtgtggtgatgcttgcctgtaatcccagctacttggcaggctgaggcaggagaatcccttgaacccaggaggcagagtttgcagtgagccaagattgcactactgcactccaaactgggcaacagagcgagactctgtcccaaaaaaaaagcaaataacaagtgtgatttagtgaccaacctgagccaaagcatgcaaagcctcagacaaacttgaagtctgatgctctgtgatcagccttcctcacattctgcccagttctgctccctaaacccagtcctgctgtgtttatctgtgcacctggtaagcctctgcacctgctttccttaatagcgtgacatttttgtacttttcatttctggaatgcctttctcatttttccgttttcaaatattaatccactttccagatctggtttaaaatctacttcctagaaagcctagatgagatcataaccaattcacacaaagcagtcccactctttaaaacaaccacagcccttcttgggagccaacatttaggcattcattacttgaataatttataagataaattactaatatctgtaaaatgtgtttattatataaactccttttaaaaagatttaaaggtttcctttctcttcttttttttttttttttttttttttgagacagctttggtcttgttgcccaggctggaatgcaatggtgcagcctcagttcactgcaaccttcatctcctgggttcaagcgcttctcctgcctcagcctcccaaatagctgggattacaggcatgtgtcaccatgcctggctaatttttgtattttcagtagagatggggtttcactgtgttggtcaggctggtctcgatctcctgacctcatgtgatgctcccacctcagcctcccaaagtgctgggattataggcttgagccaataagcccggttcctttcttaatatattgcagtacagtagccccacatggctacgtgtccacaagctggctctgtccacagtgggactgtgatgtcataccttttgcctaactcagaaggctgagcagggaaggacacaaatgcagattggtttgaagccaattcaaataaattgttaattgtggtttcatcaaataatcatttgatgaaaccacaaaactttgttctaacatgttcaaatctattgatctggagacattcattattacacgttccaactcttcctgatattgacctagatgtcattgattgagtcagaactgtcatttcaaatttaggtcacccagcgggatactacctaatttcctccagtcaagtcataattcagaaggaaatttaaactaattctatataattaataaatttaaaaaacggaaaatgatttatgaaatatgaggatccatcagtctctataataaacagtcataatgcaaaatgtttattcaaccaaatacgtagttttgtgattatatagtttttatcagtgaaatatgagctaatagtatctaacaaatgattaagagtccgcagtattataattttggggtaccttattacagtaagctaaaattaatatagattttgaaattttagaacatttccttatcaatgatctcaatgttaggacaaaaatactggaaacctatgtcacagggtacacctgcatgagctgggatttgctgttgtgttcacccatatacaccaagtctcctactagtatacagcacatgaagacccttgatcaatactaattaaaatatagctttattatttgcctaattaaagcattgaataaatcattattctgggctataattaatctattattattacctcatacctgtaatcccagcgctttgggaggccgaggtgggtggatcacttgactttaggagttcgagatcaccttggccaacatggtgaaaccgtgtttctactaaaaataacaaaaattagccaggcttggcggtgcatgcttataatcccagctactcgggagactgaggcaggagatttgcttgaacctgtgaggcagaggttgcagtgaactgagtttgtgccattgcgctccagcctggccattaagagcgaatctccatcccccaccacacacatacacacacgcgcacatgcgcacacgcacacgcacacacacacacacacacacaaaatcattctgaagatggaagaaacctaattttcttgcagttttcacggaattcgttatatattccaagaaataggctgaggccgtaatatatgggattaaatgttttgtctgaaattattttttaaaggttattgccatcaaaactgtacattactttctcctttaaatgtgatgaagctcaaaaagggtgttaatcaattatgcaacaattgttgattaattatgaatcactgattactaaataattaatcaaaaatgtataattacaaacatttaagaaatttagagtagattgacctacttgtaaatattctctaatggaaaacacacaaaacctgagaatgctactatgcactctggaattactgccttgtatctgatgaaattcgatggcaaccctagacattctcaagcaacagtaaaattactccaaaatgcattttcttaaagtctgtatgtcggtagtttatcctgtttccatcttgaattactgaggattcttgaatctcttaatagtgtgtcattctctcttgcaacgtgtaaattgatgttattacagctctggagacccttttagaaacatggcaaagatgtttgccagagatttgaactttgatgaacatgtttctctagggcttctggaaagagttaacacattcactggtgtttgctcattatgcttaggataaaaagcaaatcagacagcttctgatatttattttttgatacgttctgttgtatctaggaagaatacagaaaacaaggcagactggtaggctgagttccataaaattaaagttttaagatgggcttggtggcagctttatgttctattaattttttttttccagaatcttagcaaattttatttctcatcacagccccggctctgtggggggagtgatttgtttattttttaacagaaagatcattactacaagcatttcatgtttgatttttctaagcacatttgctccttgaatatattcctaagcccaaaacatgcagtatttcgtttagtgtatgcattagtgactgaggcttttgtcagggatttagcgagagcttaacatatttttagaaatagtttttctcaactatgtaaatcatgcataaatatctacctctgccagagggatcttaaaaatgggtttgtgttttgtttcttgtggattccagtgttggtgtgagttttaacagataaataagggcaagactatttttgtggaattgtttattcttacatttttgtcaagaaatgcatgatttagtgttgctataaactgatacaagcaatattacctgtttctcaagggtgtaataaaacatagcgataacatatcaataacaatagattccctatgaaaagtggagtattagaaatgtgttttcctccataagagcatctacaaaaatgcatgagaacacaaactcaaggtcttttccagatgctttgtgaagaaaggcaatttcttttaatagtattttttacatgtttctttcatattttatttgcttaatggactaaattatagagaataagaatctttgtttaaatgatctatgaaaatattgtatgtaggtttttttaaaaaaagcttgcttggattgactttaatatataattgataaattcatgtggtatatgtgatattttgttgcaaacatagaatgtataatgatcaaatttggggtatttgggatatctgtcaacttaagtattatttctatgtgtcgggaacgtttcaagtactctttttacctacttagaaattgacaaagtcactactctgtgctatagagcagtagaatttataccttctatctaactgaatgtttgtaccaaaaagactggaagcatctgtctttgattggaagcagccactatcccaaactgggagaaaaacccccacctccccgacaaacttagaactattcatctgtgaaatacagacttcgactggttgtgtctcacttagagacgtaggcaaggcagtgaacagacagctgtgtttatctcgctgcacacgaagcagccagtgagcttcacagaagggcataattggttgtgttctcattcctgagactcctgtccagctgcgtaggaattttcgatgatgtcaaagccaaagttttataaatgacaggaccttgtcttttcttgggcttgactcctgctgtaattggaagctgttactttctgtctttcgtttattattttaaaaaaccagcatgtatttctatgacttattctaatgcgcctatcagaaaattctatacggagaaacagtcaattcattagggaacagttctatgatttgaggcagctgtggcactgatttcactgtctcatagaagaaaaaaaatcacatcttttcctatgtctatgcaaaacttggtattttaaaccatattcctaaaataaactgaatgtttgaaagagactaaaagatttaaacgaagcaaaaaaaatgaatcagtattcattttttttcttatttctgtgactcaatgagccaatagaaatcatttcaacttaaaaagtccagttatgacagccccatcaaaattttgaagtgaatgtgttataagacattttaattattgccaaaggatgagcctcacatgtgtttatttttccatgtcaatattgggaaatacctcttgtttctatggcagcaatacattgccaccaatcccctaaatttgataaaattgtattttttgaagttgtattcttctagaacaaaaataatcaaatagcaacaattttatatgattcaacataatacattacttaaaaaaaactaattttaatggttaaaaatacagggggccaatactcaaggtagtttgaaagaagaaacttctctctccgagtcaatattcccaattaatactaggtttgacattcctaatttaagcaggttaaattgaaattcaataaaattgaattgtcttcagttctcttgttgaacctcgtgattcaccattttccagaaatgaggagaaattaatgaagcagtgatggttgatgccactacagccttatttttctcacttgatcatttatgtgttgccataaaaatgctttccacttacagaatacctttctctaacagggtcgaattactttactgattaatcgtttaagtgtgatgcccatttcactgggtggaatagtacagaaaatgaaactcttacaacaaatatctctttactttcttgtctttaatatcatcactattttatgccattctttaatctcatatttcaggagaggtagcagttaattttatctgattcagacacaaggctgttacagttttcttataaatcatttgatctctttgaactaatttataaagttctcgtcttcgttctttatatgatttattatattggtgatatgcgaggcactttcttcagctttttcaattatttcagagcaaatatattgttacatatgaattatgaaaatttccagatgacggaatctcattgacattggaacattataaagtttctatgaaattttctatgtaatacaaaatcatattatctgcatattttcctggaacccctaagggaaagtagcaattatacagacacacagccaccaccccccacatacacacacatacgcgcgtgcgcacacacacacacacgtgtattttactaagtgttacagacaattgccaaataataacatcaaacatgactcgggtggtactaggtggcaaagcaagaaaaggccttgtttagtttccctgcatagtgagtttgaaggtacaatcacgttatgaatggctatggaataaattatcaaaagtcaaaaacaaaaatgcaagctgtgcatttacaaaagaaaaataagttgaggaacatattaaatttgactatgagaaaatcaatttgaattttattaggtaaatcatttcacataaatgaaaaatctgcatccatttacttttaatacatgacagggaatggatgtgagttaatactgctcagttcttgaagtttacataaaatattttagaattatataaaatggtaggcttaaatccttaactaaggttttgtgtttctaaaggctaaggaaatagttaccaaatgagctaactttaactggtatttttgtataacatttatattgagctaaccctcattctaagcacttggcatatattcacttgatattcctgacaatactgtaattaccccgtttgcaggagaagaaacaggtgaagaaactgatttaggttaatatacttggtaagtggccggacttggatttgaatggcactgtttaatatggcaaccgcttgccccatgtggctgttgagttgtagacatgcaggtggtccacaatgatatgtactagaagcataaaatacacagtatatttcaaatatttagtgtaaaaaaacatgaattatctcaattttcacttattacatgttgaaatgacagatgttttggatatgctaggctagatatcaaactcagttttagcctttttaaatatggcccctagaaaagttaaaattacatatgtggcttgcatattatttctactggagagcacagctttaccttttggtctagctgtagggagtagagctcatgggtctaggcttttaaacctaaggcctctttactgaagagtagaacttagtctgagattcttattcatgtctattggcaatcccctggaagtctcttgttagtttatacatacagtattcttagattgcaggtaatgtttggaaatttaacttatactccttactgcttaaaatgttgagtatcagatgggagattttagaagcagttgtttcatcccatggtgatacaccggaaactcttgctatagatgtataatattattaatatgtataacacatttaatgattttcttattgcccttcattagaagtattttttcctaattcataaaactctatcttttctcctaaagaataatatcagtgaattcagatgatatcaagacgtgtatttatcatgaatgtatgtaacagttgtccctgaattaatagctatggctccttttattggtaataaggtccatctgtttcattcagttttattctgcagccagaggcagtgaagctgtactcatctgtgtgactggaaagtaaaactcggcaagacaactcaataagatcaagagcaaaatgtcctccaattttaaacaagattttctggatctcttatgttcttgaagaatgatttctatctctgaccccaaataatccagctcagttttttgtaaacatagaaaaagaatattggatccagacttgttggagagacatggagagataacttttaaatcatgaaagcactatcactttattacatgcctgttggcctggggaatatgaaaaatgataccaaggttctaaataagtttatgttttaatgttctcccattaggcaaactttctgagtgggcgtgttcaagcgacagtagatttttaaaccagtatgttctaaatggttgaaaccgattgtccaaaggctgttggtatgattgctggctgtgttctatttaatttttgggtgaaaccattagtatcacacccattatgataagtgtctaggaacatattaagttgtatcactgaaagcctttttctaccacaagggatccaagaggatgtgttttattcactatgattattatttgagagtacagatacaagcttcaagtaagttacaagagcttaattctttagatccatgtttccgtctttttcctttgaattcacagaacttagcaaaagggtctataatctagatagtgccctaccaatgattgtcgcaggaaggggtggtggaaagatagatttacacactttctttaaagcaaataattagcaccctttttcaaccagcatctgtagtaaatgctctgatcatcgttcctaatgcagcaaccctataccgctgctgaccgactggtgctggcaatgaaaccaatctgcctgccgccctctgtgactccacaccgccggaatcgtggtggtggattcctcttttgtgtagcacccaggaaacataattgcaagtaagcatgctaataaggacattgagcccacacgagtattatttacaaaagtcaaccagatgtgctatctatgggcgagagcaatgggatacacaacagatttgtattttactgtttgggaagtttttccaagtgaactcctactgagggtgggctttattgaatttagaaaagcagtagaaagagagcttgtacttccctcatggagacctttgagaatatactcctcctcttactagtaatattaacaataacatagcttgctattattattaatattatggctggcttctatggatccattattctatgtcagatatagagctgatagtttacatactgtgatatgattcttaacagaagactacaggtagtatttttattcagtttaacatataagaaaacatttatagtgtatctacacatgtatgtacgtgtgcatgtacagtattatgtatattcatatgtattaggattattactgtcattactattactgtaaaaatgctgagtaacaacccattccaaagctcaggcccacggaacaatgaacacgtactggtgtcctgctctctggtttgtctggggtttaggtgattcaggatgggctgggctcagcttggctataagacaaggtttcagctcaagtgtgccccatgagtctttcatttttgtgagaatgtttggctgcctggagcacgtttcccacccggcagtgagggaagctcaggagagtactgccctgaataggttttaagtcagtgctgtcaccctacccttggaaattagccgaggcctgtcatagggccatgtccaaagtcaatgtggctgggaaataaggtttgctttctgtgggagaagctgccgaacccccgggtgagtggtggacaggcagatgggaatgaaaagttgggtacaataatgtcatccactttaatcacagtcctaaattactcgagtagtcttctgtatttcccattaattttctatgagaatgtattagtctgtggttaaaaagaataaaaatatttaattctttttctatttcaagataagtctattttgagatgatgaggtagtccagataacatttgaagttagtctttgtatgtggttcttttgaaaaatcaaaatgccacatagaattgaacataaataatagcttaagagcgcaggcatgcatctgtacttgctcattcaactcctaggaagggtaagaccatctttcaggctgcagttttattatttttttatgacaccttcatcttttactgcttccctcaaattcatagcatgagaatttaaggttgtcacaggactagatttttgtgatcaaatgggtggttttcaaatgaagttcatcgttcaatgaatgggctcaacaaagcatactctacatgaaactcacaggcactgcgaccatggttcaaatgcttcttttctttgtatggtttcaggatgattttaattactgtttctggatgagaagagaaagttaattacctttttgaaaaatatgattatcgtcaagatttctctctttgttaatatgctagtagcacggtggcaggaaaagagctccagaggaaagaagtgaatgcaatgtaaactaaatagatggcccacagatgggcgtgggaagcaggcagggtgttgatggcactaacatcatccaggggacttttatggcaaagaactttgcttcatccacaggctggaggtgagacacgagttcaatactgcaacgctgaaaactgacagagccagcctcccatctagggtggaactaggccaccttcctagggtgtagcgggacttgggtcaggtctccgagcatgtgcacactgcatgatcctcagtaagctataggtttgaaattgcacctagagagctggtggttgtctagagtgtggctgtctgggtgcttcacatgcaattgagttatcacttcctagagacttttgaaagttaggtaattaaacgtttttgctgggttcattttaaaattagagattgtgggtctgtaaatgacaccgaaaatccgggtttccgtcatctcactgtctgtttcatgggaggactcagataattctttgagtatttagtttgtgtgagaaagaaaagcccttggtaattaaaaaatcgtctagcaaaggctcaggtttactgctctgaggtccacaagccatcgcatttgagtcaccatgaatggttacgttcacaataatttagcatatctgtgctgcatcccacaatgagcttccactttcgagttttccatgttccaggaccacatttcatctcaacgtgttcaccctgaatcatcctgtattcattaatggaatatgacagggtctggaatttgaacaaattataatataatgctttatgaggtctgttctgtcatctgcatgcaaagtattttattttaaaataatttatgtgtttaaagatggttcacaagcactaggtaatttaatgtatgtagcacttcctcagttttggctcagcgtcttcctctccatttcacatttagagcaagtgagaggggaaggttaagtgatgtgatgagggagtgtggcagagtgacaatgcagagtggtggcgtttcactcgctgacttctcgacgcaggcttctcaacccactgagcctcctggctgtagtaggcaaggactcggtcacatgaagaccaagaaataatttatcacattagatcaccatgagaataagaccacgaattggcagagtgcttcacaattttcagaggatattgaagtgttctataacatgaagcatattgcatagaataaaaagatatactaaatacatccatgaaagagatggacaggtgcaatacatatattcttgaaatataattttaggactatgattatcgcagatattatctctctatacaaacgagtaaactgacatccagggggaaaaaacatcgtccctgcagaatcaggtctatacctcattttatatgccagtattatattatcagttggatacttgggtacttgaaactccaaattggagctgctccattacaaagtttgttttctgtataattctaccttctactagatttaaattaatcctatgtgtttaccaggaagtggaaattaatttcaagttcctatccctttttgttaagtaaaccgctttaagtgttttcttttctcttttattagggaagcatatgtagagaaggattgggtacaggctgttagacaatgagccatgtctgtatttgttaaatagtatcagtaatcatatctgtattaggtcccctaggaataaattgtatcatgtaaacagaacaaatactaagatacttttcttgaaggcttgcaggcatttcatatagcagtcataaggatataatgtatgaacataatattggttttatattttgatcactaaaagtcagtaaaaattctttgtaatattatctctctctgccttttatatcccctgtcttccttcgtactttccttccttccttcctccctccctaattccctccctcccagtgttcctccctccctctctctctctctcacgtccattcttttgtctggtggtaatataaagtcagtcaggaatccctttttaaataaaaaaaaaaaaatctacaccgaagtctgtatatgactggcaatttattcagtaattgcatagaaagctttgtaatttggcgtcttaaaatacctgcatcaaaatcaatgattctctattatatttaaaatttctgaacattccatagcatgagtttttcaattattaattgcttctgctctgttggttttccagcttcaataattagaggcttattttcctggagctttagaaggtgtattttaactcatctagttaaatatggtttaaatttcctgaaaattaattcattatttggttccattcagaatacaagggcatctagttttgatgtataaaggaaatagtttctcgttattgtggaaataattttaatggttgaacaaataaccaaataaccatgaaatagaacacacccctaatactgttttgttggcatttaaaagatgtggctttccaatatgtgagtagagttgtggctcctgccgtctttgacttacgatacatctgtaaagacttgtcttgcatgaatgcccatcgtatttatggaggctctgtgggctagctgctttctcaggcagttaacacttggctctcattaaattcttacaaaaaatatgtaacacacacataattactgtgtcaaggatattctatgagctcaaatgtagagcaccaacaaagagaaggactaaataaataccaataacgttctttgaaaaaaattatattagtattttaaaaggttactagaatagacattcgtggaaaaaagcagaaatgagcttaactttattttactgatatgttttcattttgaattctattggatggaggatagaagacatagatcttttcagtaattaagatctacaaaacaatagtagaatcctggctttcgattttataaataaaacagctgagatttacagtcaaatttgtctctggtagttctggtctgttgaatgtcgggcagattccaacctagggctttctgacccctaaccctcctctcctatcatgcaaaaccccttcctataaaagagacaagagacaaatctagactgggtatctaataactatgttgagtacatcactggtagttaatagtaactgaaaccctttttatatttcgaaggcttatttccatgaattcttcactgaacactaaagggaattgctttatcgatgtttctgtttggataacatttctcagtaaaccataaaccatgaatttatattcaaaagtttggaatttatcctcactttggaaagtggccaggatcaacttaaagaatattaacaaatagcttatattcatatatagtccattgtatgggcaaaaaaatcatatacatgatcttttaaataagactaagcaattgtacttttctgtaacacaatatcaagatctgtttttattgaattagaaatggcaccggagaaaaccaaatgatatctggtgactttactgctggctctaataacataaagattctgaaaatataatttcttgtagaagccagcactaagatcactttattctgcctctctccagtggttaatgtcacacgatttgaaaacacacggatatgacatgatatttgcatctctaaggacatactatatttttcaaaaactaagtattattggagtctgtccttccctatgacgtcacggattttctatgtcaggaagcgagaatgagtataacaataaatgattgttgacatatttaaacattctctttggaagataatatcaaaacaagaaaacaaagcctttcacagtattaatgaggtattacaaagttatcagaagcatggaaatccatgcctagaaacagacaggatacctagagtcattgtgaattaagtgtaagaaaaaaacattgtgatctcttcataaactatagtttgaaattataaagtttcaagttgcttggaaattcacactctgtcttttcttaagtggtgtcttgtttttattgtttgatttcgtggtttgttttcaagtccactgtgagatggcacacatgataaaggttaattcccaaagttaagttaaccacggggatgcttctcactatccctacacacacacacacacacacacacacgcgcgcacacactcattttgcttgttcctagttggaggaccagtcataggtcaagatgagcctgaaaccacgaagccttggctgaggcaggcagaggaaaagggaaaagggcaaacactactagtttaagccaattgtactttgatgcaaaatgagcatcctatagatagcataactaatctaaatgagttcctttgtgcaattgctcttcgattttgagatccctccagatggccttaaaactgtctgtggacacttaatattttctatatgtcatcaacttcaactaggctatatagctacgtccattaatgccctttgcaaatggtctgtctacaccagggaagcaaaatgctgagccttgcttcaatgatggatgcagtaaatatgaaaggaagagatgatcaaaatgtaccagttaccttgaatcacagtacgaatgctgccttgcaaatagtacctatgcttaaaatacattgggcttgccaagtctcagtagtctgaaacaataattctatcctttgtcattttagaaaagagtagctgtattcatttctctttttactctcagttgtatttttttttctttttgcctcacaaagtttctgtgtttttcctattattaatgtggggtggtgggtagtttaggctgccttgtgtagaaggacagggctccattattggacaggctgaggacactggtgtagataaagatggtttcagaatccagagtgtgtcaaagcggcatagaggtgctcactaactgagatgattgagatatgcaaaagagttaaattaatagaaaagatttgtttctaatttagtaactgctgcccttcaaaatgacattaagtacttgcgcccctcaatttgaagaaaagaaaaaaaaaagccatctgaggctgtcaagtccgctaagagtagctgactggccgaaatagaacccacggggagagggtgtctctcactttgaatctgctcagtactgggttctggcagcagcagcagcaatttatagctcacatcttccacttccaccctccttgtctgtgatacttcatatttcattttgcaattaaaggtgacctgaaaatgctgagaaagtcatagatcagtcctcaaggtggccgcaataagatttagctaagaaatgaccagaagtaggaaaagggcacagacagtctgaagtaagacattgatttaaggtaagatacaaaaaatgtaaaatgacaccaatttttcttttctttattttggctcatgaatttatcatttcagatctgtaggtttttttcccttttactttttacgtattaaatggtgaatccaagatattgaagacatcaggcaagcagttgtgcttacaacttgggataaaactaaggaaagaagtctgcttttaaaaaataacaatcaggagatttatttccgatattacagaatctgtgatgagtacaagacgtaagttccatgtgtgaaagggaagaattaaagttgaggtttcagggcttggactttgtgccctgcacccaccactcaggtgccctccccaggtcccgaaacccacctcctaggtggtgtctcacccaaaagcccatcccaccaaagtggccagaggccttaagcaatgcagctctggaatgagggttgctgcagaacttagcccaacgtagctgacctggacaactctgaggctccacagccccctgggggattgcaccaaagatgggtctgtgactctacccctttgctaggcgtccttccctgctctgcctctgacggtctgaggtctttatcagaaaactcttcttaaaaatcactctcacatgaatacttgtgtcagcattgatttcccaggaattaaacctaagacaaaggtgattaatttttaattttccttttttttttttttttgagatgaagtcttgctcttgtcacccagcctggagtacagtggcgtgatctctgatctcagctcactgcaacctccacctcccaggttcaagaaatcttcctgcctcagcctcacgagtaggtgggattacatgtgtgcaccaccatgcccagctaattttttgtatttttagttgcgattgggttttgctagtctcgtctccaactcctgacctcaggtgatccatccgccttggcttcccaacgtgctggggttataggcatgagccgtcacggccggccaattttcctttcttgtattaataacaattatataggaaacaaaaaggatacgctttatataaaaaatacacaggatattcaattttatatcattcaaatttttggtgtaatagtaacagtaattaacataattactgtattttgattgatgtctttacaaacttttcttatgttagaaaaaatgagaagcatcagtgtagtctgcatgttcgagggtacatgcatcgctttcgaaagctgcatgcatagttcattttaccagtccaggtctgttgaatgtttgagtactttcttacacaggttaaagtttctaatgctggaaagagcattctaatacttatctctttgcatattgtcacttttttttttaaagagacattcctatacgtaaaatttccaggtcaaatgtaaagctttttgacatgtaatgccaattttgtttttaataaatattgtattgataatctccaaagcagtgaaaataaagtcccaatttttcagatacttgtgtgagtgcccagggattacttttttttttttttttttttttttttttttgagacggagtcttgctctctcacacaggctgcagtgcagtggtgcaatctcagctcactgcaacctccgcctcctgggttcaagcaattctcctgccccaggctctagagtagctggggctacaggcacacaccattacgcgcctggctaatttttgtatttttagtagagagggggttttgccatggtggccgggctgaggatgactattttaaaacacttatatgatctagggctaaaattactcgtcattgtattaccagtcatgtctttgattataaattaaattgaacatctttgataaacttctttaccaattgatcattccttttatgaactggtgagctacatcggtgttatcccttaccgtttcactcttacagttttcaaaacattttttcttattcccttgtgagtgcctgtcatgtagtgactttatgtaagcacatctctcatgtattgagttgatcaagatcccaggggcgtgacccatggcccggaaggaaagatgcgcagggtcggccaatgcaagccctgacctctgtcctcaccagcccacgctcctgctggaaacccccctggatatcagaggatggaggagttgaggaaggaggatgtgggcgtgcagaagcatggagagtgaatttggagggcagatcaagaatggccgatgcaaacagttgctgaatttttactttggtctgaggtcttactttatcttttcatttatttatggcatctgtgatatacagaggttatatgaaactttaggcagccaaaatgattatttttcttctcccagtttctacttttgaagttctactaatgaggtttttatcagcataatgttacatacctattaataaatgtaagtttctacttttttttaacaaattggtatttttctgaaaattagtttggtgtatggtggaagactggtatagttttcttgaaagaattgaccaggttttagacgaatttttattgaaaaagcattccaacacacagtgtggtaactttttgagagtttattttccaccttagcttgcctgtgactagttgtcagatactaacctgtctgttcacatatcagagtaagcaattttcaattctgtactttttaatagacattttatatattgcaaaatctcatctcctttttaaaaataaaatatctcccttaaaaattagaatatttttagtcattaaaaatgcacatatacaccatggaatactatgcagccataaaaaaggatgagttcatgtcctttgtagggacatggatgaagctagaaaccatcattctcagcaaactagcgcaaggacagaaaacaaacaccgcatgttctcactcataggtgggaactgaacaatgagaacacttggacacaagaaggggaacatcacacaccggggcctgtcattgggtgggggaagtggggagggatagcattaggagatatacctaatgtaaatgatgagttattgggtacagcatgccaacatggcacatttacacatacttaagaaacctgcacgttgtgcgcatgtaccctagaacttaaagtataataaaaaaataaaaatgcttcgagattttggctggaataattttgcatagatgcatttgggaaaactgtagtctaggcacatatgtatgtcttcatttatggagatctgtcatgcccttctgtggaattttataagtatttaagatgattttcgtaaaatccatgaggaaatgtctttatatggtttctcttgataattatacattttttgttacatgagcacaagtatttttaaatttctctgaatgattagtctcagcatttataaaagttacttatcttctacatttgtatgtacctatcccagttaaggaggtatctttgttgcttgtgaatcttaaggaaagcattcctattagcttcagataattttatcatgatttctatatcttcgctttatactgtttcaatctctttttctctctccccccataccctggaataatttcgtacttttatattgtacttatttttgctattaggtcaggttggtgcaaaaggaattgtggtttttgcattaaaagtgctggcaaagaccacaatgacttttgcgccaacataataaaaacatgacctatatttggtacttaggtgttctgcttttgctgttttcagcttttgaagtggcagcttgatccctagattcaggcggaacactctttcacagatgctccctttctcctgcttcattccaggtgcactctcagctgccacaaaagcaagagcagcatcattgttttaaaacatagttttcaaaacagttaaaactcaccatgcatagtaaaggatgaaacctcatctccctcattggaaacctgtccttactgtgtgggcttcagtcagctgcctgcctggagcctgagatgctgctgcctgggtttgtctcatttcttccatggcctctgcaatcacatctgtattcatctctgattcgattctcactgcattccagaacacatggacagaatctgttgcttctctcttaagaattagctgacagtctccctttctttatggaataagatgtacctcactttgggtggcattacaaaggcctgatgaccaggcaatcagggccgctctgtcctgccccctccatgcagccacactcagagacctaatgtgtccatagcgtttcagttgtgtgcatatgtgcggcttgcctgaccccagacctttgcaattgtccaagagaaattgtactgcacaagataaacatgcaaaggggaatttactcaccgtgattgcaaaaggggaaggggactgaattcggctccactgaaataaaaaatgggagggattttgagccctggtacaaggagggaaatggtcaatggatgagtccaccacgttgagttggttgctcatttgtttcccagtgtttttccccatgggtatgccacctgtgtttgctaatcagtggtcttggagccgaggtctgcagcctcccacagtgagtgggagacaggggtgctctctagtctgagagcgtgtctgagggatggctcccaggtcattgagaaagaccattctcggtggtaaaactgtcaagaagctctcaaagatatttacatacattacaaaggggcagaggagaaaattgcaaatgcaagtttcctaaagtaaatgcccttagacagggagatcaggaataaactttataaagctgggtctggctgaggatatgtgaagatcatcacgttggtcgcttgtcatctcatctccatggaatgccttctgccaaatcctctggccagctccttgttccagcctcacagcaaaggaggcattttcatgcaggcttttggagcaactagatgcagggggagctggtcttcctgcattttcttcccttcattgtcgaaaccaccttgatgaggcttaagtttttttggtcctggatctctccacagacagtaaactccttgtggaataagaacatttacttgtctttgtaatgccagtggctctcctggtgagtgttacattttaaatacctgaagccttgcccttagctgtatttgtttctttgctttatgacatatcagagaggcttaaaagaaataacataatatcaagtagtgatggcttaaaaagccttgagtatttcccttagtggcaatattttcagtctaccttaacatgagaacaacacctcatggttccatttatagctcatttgtgtttaatttgaagaagggctgcctcagtacagtacttagtgtgatttatgaattgcactcagagtacctgaaggcgtgcacaggtacggaggtaactgacaagagccctggaggacctgtcaggatgcctctccgcctggatctgcggatcccagttcacagaagataattattttccatattgtactcatttatcctagaaattcctttctgaggaacaagtgtgtgttgttatggttaaagaagaaaaaacagaaaatttgaaaaaaagcttaagaaagctggccgggtgcggtggctcatgcctgcaataccagaactttggaaggccgaggtgggcaggtcaggatatcgagaccatcctggctaacacggtgaaaccccatctctactaaaaatacaaaagttagcctggcgtggtgctgggtacctgtaatcccagctactcggaaggctgaggcaggagaattgcttgaacctgggaggcggagcttgcagtgagccaagatcgtgtcactgcactccagcctaggcgacagagcaggactccatctcaaaaaaaaaaaaaaaaaaaaaaaaaaaaaaaaaaaaagctatgacaccagcagacctagaaatgtgttctgattgcacctcaatatgtgagctggttaagcgtcttttcacctaaaaatgtggctactacattcttagacgtctttaccagtttctgtctactgttgttattttttgctgtatctattccacctgattcttcactattaccttccatatattaaagacagcagaaacttaaacacacacccacccaccccccacatctttctttgacctttctacccaacttcctaaggcaccattctttctcttctctggctttactccaccatggaaacaatagtaggactcccttcccagcgttctaaatgaccaactcctgatttaatttcttgccacctgcaatctgcagtcatcatcacctgactccagttcttgtcttggaggtcagttttcctaaattgtaacttggaccattgagtgcttctattcaaactacttcagagtccccgaatttgggcatggaattcaaatggctcaataatctgttcagagcttttttcctgagaaaatactctgccacatggccttaagagagatgggccaatagcagtcagcagaagaaagaaggtatggggacaatggggaggttcctgactatggagcacatcagccttgcagcccagaggcgtgtgaggggtgagagaaggggaagaatctctcagcacataggtggacgtgggggagggagagtcaggcagagatggagaggagagcaggggacagaacacagtgacttgctgcccattttgtactggattttaagagcaatgaggaaccattttgttttaaatgctgtcataaataagataattaaatgtaatagtgtcttgattttctaatggggatgttagaaaagaaatccctcctatatgagaaatagtcactcatttctaaggaaatgcagagaccttcttttaacaaaaattgcaagaatatcaaaatggtaggccttttatatacaatgtgggatttttcaaaatattactgacaaaaagtgtgataaaaatgatccaagtgacctgttaaaatgtaaaataatatatttaacaattgaagagaacaatattgagtttgactgtctattagagaataaagcattatatgagggaacagtacttatctgacttatctccagaagttttgagaaaaatataaatccaaccttaaggcaaattatttcaagagcactaagatagttttataagaaactgcttttaaaatgtatgcaaatactcctgtaagcctttgtagttaactattcctaacagaagtgccagttcattttcacacaaacctcaacttacatcacatttttattcatcagacatgctacctgatcattcttattaacaaacttttaatcagaggagttttttttttttttttttcctattctggggttgtggcctgctttctagatcactgaccatgatttgtcatagaaagatttctttcaagatggtaaaacgaatgtccacatcccaatgaatgtcatttcccctgtaaaagaagatttggcctccaacctctccatgtacactttcttctcctgagcagaggcgtcaacattgctattgacagcaataattagtgctgtatttttttttgaaacagtatgatagtgagcaatgcctcaaactaaaaagtttgtatcagtaaatgatagaaataatttctgcaagcagaacagctatgactgtgccctggtgtaggtgtctgggaaccagggagatggcgtgggagatggtggggaggagagaggggatggagctggaggagaaagtgataaagagctgggggaggagggaaaaggtgaaatttttaccatattttgaaacaaaatttattctatgtttcaaaatgatatcagtgtagtagttatagtactataataaaaatgcctcttctgtgttatcatttgagagaataggttctatttttccagcctaaaacaaatacatagattaggtcttgtaaatatgaaggaaaactaactcatgatcatgtcttgtgctgcaattaatttttatttactcataattactccatgatcaaggacattgaaggttaaagaatttggtacctgctgacctgttatgctatatttctaagacaaaagaaaaaattgtatatgacagtgctatattatattttccacttggatgtttgaatgtcaaattatgcaatggcttaatggcttatgtatgtgtgtggagatatatatatatatatatatatattgcatacacatatatacacatatattccatatacatatataatttgcatccctttttaatcatactgaactctatatgaactcaaatgtgctggcagagagcacaaaaccagtaggtggaaaggtttgctggagagacctgttaaaattgagctttggaaacacttggtcactttaaatattacaagtacgcctggaacgcatggtactgagtgacaaaacaccccgtagtaatgggcatcggtgtaattgaatgcagcttcttggcagctcttcctagaattgttccttttggttctggacccattgattataaattgagtgtcccatataattacaaaagattagaaaacagtagtctaaaagagggccataagagactctattcaacagtttcttgcatggacgtgctgacaactgttgagtgtggtgtatggctgaatgggtgcgtgatcacccaaagcacagacagcaaccacaactgcccagggaacgggaatagaaaatgaagaatattcagaacagctgatgagttcaaagatagactgattggctgtaccactgctgaatattgagtagagatgaaaagacgaaatgtctctggaattgaaactagagttttattttttaaagcaaattccttcttgctactggactactttaagaattttagaactcttagggaccatgcacctttataggggtgtagttaggatgtgtttgcttgttttatcactgttatttttcagttctatacatttaatctctacttttgtgtctggctaattgtgtttatttcataaatacctatgggaaagaaagataggaaggaggaaggaaagaataaaataaggagagagattctgttagaaaatacggaggaagggatctccatatagaaagaattaaagttaaaaccaggcagtgaatcttgggtaagaatgtcaccacttttctagtgagataggatttaggattaacctttgagacacacactataaaggacacttggataaacaatcttgtatttaaaaaaaaaggaaaactaacataaagaaactaaattaatctaccttttcgaataagatgaaccaattgttgctgaatgcaagctaaaaaaatttttttttgaaaaaaagtatatctgttggaattttgtaggtcagtgtcagagaatgccacccaaactggaggaatctcaaagtgaaatgtttagcacacgatgctaatgaaggaaattgaacttcttcgtcagaaaatacttgaactattggcttgcacaatggtaccagatcctggcctctctctccatgtcttaactagccttctgtgttgggcccatttttaagtgagctcaacccttacgttggtaacattgctgcttaaggtcctgcttcagatttcctcacgttagtttctagccaaaaagagacaaaacatttttccagtggctcttatacaactttaggggattggattgtttgttactccttgagcgctgtggtgagaaaattaggttcacttttcaagatcacaaaccttatagaccaagggatggggtcccacccacaacacataaactttcagggagtcaaagggctgaattggaaagaaaattggaaaacattgtcaaagaaaggagtaaaaacaagtccacaccaagaagtagtaagaaagcctggtatggaaagaggcccaccttcgtgaaggtctgtgtccatgacaggcaaagcccctgcaaccccaggcacgttccttctgcctctgcttcttccacgcacctctcctctcaagaccagtggtctgttttcttggcttatctccatgtgtttgtttcttgtctcacttaaaagtttctccctccccgtctcttctccccgtctcttctcaccgtctctctcaccgtctctctcaccgtctctctccctactagcttgtgtttcccatttactctcctgatagtttattttgcagtgcagaactttttagtctaattaggtcccacttgtcaatttttacttttgtcttagttgcttttggagtctttgccgttaagtctttgccagggcctaggtccaaaatggtatttcctatgtttccttctagggtttttatagtttaggttttccgtttaagtctttaattcatgttgtgttgattttcttatatggtgaaaggtaggaatttagttttggtcttctgcatatggctagccatttatcttagcaccatttattgaataggggagtcctttcctggttgcttctttttgctggctttgtaaaatatcagatggttatagaaatgtggctttatttctgggttctgtaacctgttgcattggtctatgtgtctgcttttgtaccagtaccgtgctgttttagttactgtagcttggttgtatagcttaaagtcgggctgtgtgatgcttccagctttgttattcttgcttaggattgccttagcttttcggtctcttttttggttccaaataaattttagaagagtttttttctcattctgtggaaaatgttattggtagtttgaaaggaatagttttgaatctgtaaattgctctgggaagtatggctatttattttaacaatattgattcttcctgtccatgagcatggaatgtttttccattagtttgtgtcatctctgatttctttctgttttgtaattctcgtggtagaggtatttcaccttcctggttagctgtattcctagttattttattctttttatggctattttgaatgtgttgtgctctcagatttggctctcagcttggatgtgatacaatattcttattatgttgaactgtatgtatttgtcttgtttgtccaaaggaactgaatattggatatcacaagtgatggagcttagtattttcccacaaaactcatcgaatgttttcctcctagaattctctgaagattcacacataatcctggattccttttcatcactataacttggcctccattgagttgcacatgaagggaagagagaaatagcacctttaagatacgtttttcgggtacatttttctctggcagaacagatctgatggctactactaaattctattacttaggcaagtctgtaaaataaaagagtactaaaagagattaagaaagttagacttattttccataaacaaaatagcaagaaccaaaatggcatctcttccctaaattacacagtgataacttaaaaaatttactacatgaactatgttgggagcattgctatacaatcaacctttatcttatacaggatcataaataagtacattctggaacatgctaaattctgacatacagctagtatgccagcattcaaaaatgcaacacaaacttccccacactggagtgagaaaaacagtttattcccaaacctagggtgccagattgtgaacaaaagctttggtggtagatcccaggtagatgcacagtaaaattatataggtgaggtggctttagcatttatccaatgtaaaccaggtgccaggcgtttaaatgcgttattttgtaaactctggggatacacagtactatcaatattagatacgagagtgtaggtaaaaatcacccagagccagagagctacaaagacacagagctgaaattcatactttattgtctatagttgactgcttttaaaccacagatggtgttgtgcatgtttggtattagaaaccggggattataattcagatcatcttcatagatgagaaacagtggcaggatagcttctttatattaactacaaataatatttattgaatattttctaagcacaaagcattcatctgaacatacaacattgtatttcattttcagtgaactcttacaagaatcccaagaggtagctttctcatgattaccttttctggatggtgattctgaggtcccaagaagttgaataaataaactgtggaacaaggagtgagaccctggtagtctgatttcaaggctgagagtcctaaccatgaatttaagtgctgtctgatctcagttcatgtcagaactctgcatctacagtctgtccttctcatatgctgccaacctccaacacctgaaaacactgggcatgtgcctgccctggagtcaggaaggagcagggagagtttctgtgtcataaatttaaaatgtataaaatgtttcaaaagcagatgtcatgttaagttaagcatgatagtttccctttatttttttttattttttttaggttttcatgtttattagtatggatctagagaagcattgattcactaatacattttatttgtgttctctaatttataattaccttttcatattgcttgattttccttcagctaaattagaaatttgtagtttttcccctaaaaatttcaatggcattgtttcttataaattacattctctgattttcttgtcagcctgcttcaaggaaatacatgtgttcaaaatgcttgctcacagtttgctccatactaaatggttgtctaccccaaatatctgagcagtaaattgagctgatccttctggagaaagtgtggttgaacagccaagaccctgggtagtcaaagagaagaccacacatcctgagctccccagtctggtgtgaggggaggacaggtgataactggatatgcagtgttcccagacatcactggtcccaaaccattacttctgcctgccactgccacaaatacagtaggaatgccatccctttcatactcagctttaaccctcagagtttcatctggtcctttatgcgcagatgttactcaaagttcacatggaatgccaaaatttccacaggccttcttgattttttcacagtgaccaagatcagaagtagagcccatcaacactacaaccctgcactgactttctgatttcaaaagcaactctactttctctgcaacccactcaaagtttttctttaccatttggagcccttcaggagttacttctttgagatcccgataacactgtttgtctttctgttggcttcgatctcctgatggccagagtctccaggaatcattgtcaattacatcagcaagaacaatttctttgtggttacatcaacaccaaattcaatcttcatatcaaccagtgtacaattctggggcaaccaggatttctccagcatttcaaatatagcctgtgtagcatgactcatgatatccaattcagtctggcctgtaacaagtccagcgaagcaaaattttgcagcaatcagctgttcctcagaccactgtgggtcattattggcagcatccttgaaaaacaactccactttaggtgggtaaacttatatccttccttgacaccaggatttcttttgagaaaagaaccagttgctattcttctgcaaacccattcaattggaatcatttcgcactggggtgcaatgaaagctgtctccccacattttctggtgaaggcagttttaatacctgcttcctataataactgaaaaatacaactggtgattttctttgagattgcagcttttccttccaggtgattctttctagctacatttcctgctgtaatcttgtccttggactgcaggaggacttttcgtagacttcttttgttttaccctcatacaattttttaccagtgttcagtacctcagctgtcgccattatcctgagtgggctgagggctgcgaccgcgccggtaagtgaggcagagctctagaaaagaggggtgatcagagagcatctctgggcggggaaggaggcgcggcccccaggcgcgccccctggcggggccccgcgaccctgcgccactctttccgagctccgctacagcggccgaacccggaggggtataggcggatagtttccctctaaaagttgagccagcggaggccgagtatcaccctgctatcagtaattagatctaatattagaaattaccagtaattagaagtggtgactgctctatctgcttccttccacattgccacacacacggggtctctccagtcttcagttagtataccaacaatattgccttaaaaacattaagatttaaaaagtgccttttaaatgaagtactagctaaactacttttatcttatttcttagcatttcacttaaataattactattttcttggaagtatcattcatagtctgaattgtgtagacctcagtcttttaggattaattgacaaatctatgtatgcatgcttgaagtttgaggcaaaagaaacatgtgttaagaaaaaaaaataaagataatggactactttcacaaattgttcttgcatgttgaagaaaaccagatagaacagaattttgtaaaagaacgtattctagattggattcaggctcagatcagagagagattcaagcatcatcttacgaatgttgatgcctcaaatgccacactgctgtattttaaatgctctctaaatataagcatcttgtctaaaagcagaaaactaccaaccaccaatttacatctcattgccaataaaataaaatgagatatctgtggtgttcaacagagaatcagcaagatacatgatgaatgctggagatgccacattagaagtgattatttattcatttacttgaccgatgcatgttctgcacctgccattttaatctcaactgctgtaaaatattatacccaaattcacatttttaaaataaacctggttgtaggagtgtttacttctagaacaaagaaagaagaaagaaaaaatagtcctaaatggatattttttaacccgttagtgaattgaattggtgaaataagattcttgcttaagagccaagatggtagagcaggtgggttgtcagggctcataagtggctgttaaaatccatttttagaagcaaacaggatatttattttttttggtcttacacatctgcacagtagccattttattcgtatttttataatttatgtacaaatgttggctattctatttcttaggaagctccagccactgctgggtaagctgcactaacctggctaccatgcaggatgtctttcctataattgttgaaaactttaattcaggggcatgactgaggagggttcagtctttggtgctgtcactgtttgggttaaaatccaggccccgttgtgtcttaggatcatgaagaacatctttaatcatttccaagtgacagtttcaccatttaacgagtctgggcaacacttatatcttataaggttcccgggagaataaaagtactattatttgtatgatgcactgagagtaagatgtgctctattataaagggtgatcctcccttcctttctcctttcttcattttgtcagtttgtatttttctctaaaagcaaagtctgggactctgagtctgtgtgtgagctgaggttctcagagccccctgaagtcagatgacttccaagtggctcaggactatggagatggatgtgaatcacagcatttcaggaaaccaagctctctggtgctgtctagggtaatcagctttctaagtctctgctggtcttgaggtccaaagcttagcaaagggctgcatgagctaatggtgatctaacccactgtgggggcattttggtacctaagagattctgaactgaggtacctcttccataccagctctgagaccacctccacaccatcagcctaagagcaaagtcttccaccaatgctttgcaccccagtaacttgcccaatgtgccccattatgaaaatcacctttgccaatgttcacctcctcatgactgctctagactaacaggcatgagctggtacaatcttctaggagcagcagaatagatcaggctaggagtcatattcagcaaagctatggaaacatgctatcttttccacatggtttaaaaattctcctgaaagaagaaagaaggcactcatgacccagagagattccttcttgcctgatagttatataaatatccacttctaataattcagtgcccagaactgatttcagaatttctgatatcagttaaaacttgaggacttccattttagtattgcatttttttaccacttatgagcctaatttagtcatctttacaaacataaactttcaatgctgtcagtatgagattcgctcaagggctggaatagacctcagcaaatttagttttaatggaatcatatccttctagtcttcctgccaacccacaatgctttgctgagattcttcttttcatgttatatgaagagagaattgtgtttaagatctttgcagatatgacttcatttaaatctcttattaacattccaatacattatctacattctcttccactaggtccttctgaattttcaaaaatatttgcccttcttttaatggaggcataatggatatttaaaaccatcggtgaaaaaagaaatttaacagtaagtgaaataattataaaggaaacaaattgtgtcaggtagaaaaaactaaatcttaaaacactaaagggtctgtctcctctcatccagtgaagatatttggtctatgtaaaacagcagttaaaatttcaatgcaagtgttattttaatcacgggttcaaaattttaaaaaatccatatgagtttgttcttccctttgtaattgcttgtgttacaaggtagcacagttcattaaatgaccctgcagggggaattttcctagacagaatgctacacgcttttctatttgagttgggagccaaatctttagttatagaactagaggaaggtaaagcctgtttacttgggcttgacttttccaattacaataggccgcaatgttcaaacaagtcaaataaaatattcattttgtaagaacaaacttttacttgagtacataaatatgaatcaggcaactgacttattctgtgtacccttggctatcttctaataaatgtcaagacatagagaaccaaatcctatgacaatccctcaaaaatatgttaaagtttacaaattatcaaatacactttttttatccataattttcactaatcgtactgattaattgtagccatgcacctcatccaatctgtgggaacttttaagctcttttaactctatattgagccaacttttattcacggtcaaattcagtgtgtggaaatatgtcacaaaagccgacataaagtatttgctttagaggagtgatatcaccaatataagaatgttttccttaggctggttgatgccttgtgtcaaagcctccacagttacaaatgaggcatcaccagctggatgacctactagaaagaggatatgcttgcagtttccactcaagtttggaggatgaataattgacacccttctgagtacaggcttcgggctggcttcagcctgttcatgacaagagctccctggagcaggaggccaagtgaaaagaggcactgcaatgagaaactgctaacccacacatttgaacaactcacagctaggttttccttagaaccagggaaagccatgtaatttgcataaacgttttaatgtttttctttatttaatgacaatacttccggtttaatcttggatacattgttctgaccagggcagcagattaccaaagccaaagcactgaattgagagtgaggagtcagaatgtagtttcagctggaacagccactgtacagctctctcccagcctctgattaggaggctgtggcgctgcgggtcttggggcactctggctggaggacagttttaccttgtgtggttttgagtgtattattcaccatcttgatttcctgttctgacagtggacatcatgatatgtttcacgaaatacaattcttatttaatgcctaatgttaagtgtatttcaactatctacaaaatttcaggtgggttggagagatgaatttgctgattacatatgacatgttaactctgtgattgaatatctgtggactgaattgattttacaatcatttattgaagtttatgaaagaggtcagtgtttatagagttaatgctaccatttccagacatgaccatctggatctcacatttgacccaattctttctaatctgaagtcgtctttttttttttttgagtgtctttaaaaacattgttttataagaatccaaatatggcacttttctgcctccaaaaaacatgtacatcataaagcttttagcatttattgaaaaaaatagcttgagttgtgctttctaaatttaaattggtggaccatgtgaaaatagatataatcaggaatcttggaaactattactaactagaaaataatatagccaaaattcatgtattttcatttttttggattcaaattaaagcgacaaagataaaatactcatctgcagaagtatgagtcacagtagagctatattgtacaaaaatatacagtaaaaaatagctgtacatgcagagtttattttcagtacctacaaagaatgtgaaatgtaggtgtttctaagctcagtggcacaaaactaaaatgtcttagagcatatttatggttttgctatggatagaccaaaatctacaattctggtccttaaataagatttctttaaatctaaagtgttcaaattctatatgtaatgaaaataaaactgtggtgtcttttataaagttttattttttaattgacctacataataattgtacatatttatggggtataatcagtagttttaatgcttagatacattgtgttatgatcaaatcaaggtaactagcatattcatcatctcaaaggtttatcttttacttttggtaaggatattgaaaaccctcttttctagctattttgagatatacattattaagcagagtcactctactgtgcaatagaacagcagaactctttcttcctaactgtaactttgtacccattgagcaacctctctccccttcctcctccctactgtaatgtctttttaaaaggcatagcctagctgcttgtgctactgtaatttgaaataattggtgtttagtgggctataattttggactgagaaaggtgcataaatagaggcaagagtggaaactctggagaaatgaagtcagagtttattttattgtcatttgtatattttttacaaagagctttttgtaagtcttgatttttatttactagctgggtatgtggtataagtcactccatgttcctgaccctctcgatatgtaaactaaaatatggaaccgtcatcgtgaatgatgttttactggcctaggtgagaagctgcatgatcattattcctcacatattaattgctgtgattaagaatggttaccatatagtaagcatttctagtgttcccagaaatgtgcatatatactccatcacctgacttcttcatgaccgataccattttacagttgaatacattgaggacatttgattaagtacaggatcagaaagtacaacaatagacaaaagactagatttgaaataagatctaattgacccacaaaagtgaaacttttattatcctattggccttatgatttttaattatctcttgtatgtgatctctttctaaaaggctggtgtctgagattatgttgcctccatgctaaacatcagataagatgacggtcagttatttataaatctgacagtaagcattcttggatgggggtaagataaatgactatagagaagagagtgatctagaaagggatctcttgtttcatgcgtggttgtaaaccaagtgtgaccccgtgtgttttgtgtgggagagtttttgttttcatgatgctgatccactgcaggagggcattccctcatcatgcttagccattgtgcctcaccacataatgcccttcaggcttctttcctttcttgcggagatgtatttgctaggttgggcacaaagcacagccactatgtgggattgcaggtgacacctgcactcgaaagaaaagacaccaccagaagatgagagtgtatcttaacaagacggcgggacacagaaaggaaaatgaggttcagaagcaggaaaagctatttgcaggtggtaattaccctatttaaggtaagacactgacctttgattgagagatagtgacaaaaacaggtcattgcttgagccttataaagacttatgcttttaaaaaataattacaataaggaatgaatgaacagcgttttcagtgaactggatgagattggagattattgttttaagtggagtaactgaggaacggaaaaccaaacattgtatgttctcactgagacgggggagctaagctatgaggacacaaaggcataaaaatgatacaatggattttggggacttggtagagaagagtgggaagggggtcagaaataaaagacaacatacatggtgcagtgtataccactcgggtgatgggtgcaccaggatctcacaaatcactactaaataacttgttcatgtaaccaaataccacctgtaccccaataacttatggaaaaaaataaatataaataataataattacaataggaccttgggcacaaaacatcaaggcaggttcgtttctcttttcttcagataaaaggttaaaagggctatataaaggagccagagagagatgataggtaggtaggtaggtagacagacagacagacagacagatcgactgatcaatcagaatgaactgccttgagttccactgatttttaaatcacacctgcttaatgtcctaattagttctagattatgcagtagagccaaagccccattatatagcgcagtatacagagacaaagcctgggctcagaaagcatgccaatctgcacaccttcagggcagtcataaataaaggttttgtttgtttgcatttttacacataatcccctatcataggcgcactaggttgtcaaagatgctgaaggtctggccaattatggcacaagtctgtgactgtagtaaatgttgctaaaatacaaaacgcgggtgtatcatattcaacagacatcctgaagtacgtgccccatgagggtctcagaattgaatggcttgttgcttccattgtttgtgaaagagaagagaaaagaatgtttgctgaaaagccaagaatttatttaacaatcatttggccaaagtaaggtgtatttattttcttattggagaaaaaaaaaaagaaaaaagaaaaagcaaggccccgaagcagcaagcctggggagcagttgctgctgctgtttggaagtggaagatgctgcttagcaggcttccaggcccaggaatcccctgggtcgtcattgccaaaagggctctggcatcagcaaaccgcaattagcaggatttatttcttatttacactttcctttggttttatacattcgtgtctggatttttcagtgatgaaatgttgcaatggagactatttataaaaatgctaaagccagcttgccagagaagcttgagaagtgctggaggcgtacagctaatgcttcctgtgttcctttgagctaaacatgatatccgttttgttcttgacatttataacccttggttaatgttccttttctctaactgcattgggtttaggactctgcatagggaaataagaaaaaaataaattaatgagcttcattaaatatacattgtggtgagttttctctttcacaggggtaatgttgctggtagtaataaaagttttaaagggattatgaactcttctgtaaaaaattatcctttgagccagttcgagttagtttcccttgattttttaaaaataaatatattgtgaaaattttggtaaaacccctatacatggaagggattcagaagtaatgtcaatttctacaggaggctgggagacgttaacataacaatattaatcagaccagttagcatatgtttgccaccactggaaaatattttaaaccgaagacttcagttaattcccaaggaggagttctaaaattttaaacaataaaagcagttttaaaatgaggatacggcctctcgtaaggattctgtatgtacagctgtcaattcctgaaatgttgattaagatatatcaatctggtcattgcatacctatactgttaaacacccacctatcaattctttctaaacattcttaacattatggctatttaaaacccacaggataagcaggttgcttccatatattgtaaatgttaatcatttattcttttgtcctaactacattgtatagcagttcttgaaagtaaatactatctgacttttgatcattgcatctcatctgctattctaagcagccctaatgaagtgtatgttatgttctcctaaacaaaccactatgagagcttttaatcctaaagattaacactataaaatgggcatagtcccatggaaagtatttctgattggacagtgctactcaggtgtatttgactcagatctagaccactcccatgaaggtcagagggtcaatagtggtagaagtaggacctgcacatgacctccctctcacggaatttccaggttgatcttcctagcgggaagtattgatctataaagttatgatttgctgtatgcttataccgtgccacttacagtgcaaagtgctttttgtgcattatctcatgcagaaaatacattacaattcctggaaaaagtccaggtacttcaaattaccaccggagctctagaatcaataaattgaaaggaatgagaagaaaatcaagttttgtggaaaaatcatcaaaacaatggggatatcataggccacatatggtatcatcaaatagctctgacctttttatttgcaaaattagatgaccagcccatgtgccacagtttgctgatgtctgatatagattattcattaataattgcaaatctgaatattttcataagtaattttaatgaatggaaaattttatgacatatttgttttatatgtaatgtatatttatattaatttatacataaactgtattttatatgtttatactgatcctaattttaaaatattgcaccagtatgcctgtgtgtgtttatgtgtctgaattttaactctccactaccatctagaacgggaatatatttaagaatttgccatcatgaaaccaaaagcttaaccctatgtaaaacgtatttgtcacacatccctactacaaccgtattatagggagtagccctttgatgtgggataggtagtttatttgaggatttatttcagtgtgtcagaagtcaagtgcatagttgccgttagttgagatttgtagatgtgaagtctgaaacaccacatgcttccctggtcatgtttactctttgacttctttttgtgtagatacatgtgcatgtattacattttgaaacacacatgcattaggttggtgcagaagtaattgcagtttcaccattgtttttaacggcaaaactgcaatcacttctgtaccaagctaatacagtattttaaaagcaaattctctaaaaacaatcaaagggtatgtacattcttactgcacatgtaggattagctgataaggaacaacagctctgtgtactgcttttaaaaaatgtgttatgtttcaggtatacactgggatgattgttttattcttaaatctgatcttattataggagtctaggcacacatctgtccctaacaattgtgacctaagggagaatgttcttttgagatgtccccctgagacatctctctctcttcatcatccccaagctcaaaaccagacatctcatctaccaaaggcactctctcatttactagtcccagttttctggtttcgtccacctactgagtcaattagacttaattgtttctcgcactgccttgcctcctgcttcagagaggatgctctgcttctcagcatggtttagctgtctttggtaaaataacaaccacaaggtaaaacaggaagttgaaatggactgtgtttaattatccgtctcaatgtggagctcactgtgaatctattgtctggcagcattattaccaaggactgatctaaataaaatgttttcagtaggatacaggctggagttcaccatgcaacacaccgaactttactagatagaaatcagtcacctgttttacaagaatacgctaaattgatattgacaaataattgttagctcgtaattttacaaacaccagtgcctttaatcttagtaacgttgtggaagtgttatgatctccttttaaagatgaagataagcagaaaacagtaaaataatttatggaagctccagaatcagaaatcagtaagagaattaaaatttaaatcgtctggctctaatataatattccttgtattttcacaactttttctaaaatataactgagtgtagtatgtggcactttgctacaaaattaaaattggaatcaagccagtgttctggttgtctccctgtggtaaagaatcctgacttatgtcagttcacaacccccctatttaaatattttctatgtgatagtacctggaggtatcattgaacgcgaacgtttatgcagaagtggagaacaatgcagcccgtagtggaatttcacagaaatatggtgccaccattcctatggggccctgagacgctgttggttcctaaccacaactctgcttcttgttctctgagcccgagtgctgcctaatataacatgaggatccgaagaattctctagaggcaccataagaataacctgagttaacgtatagtagatatagtagtagcactgtgcagttgttcaaaacttagtagcaatattttcatattaatattaaaactagcaacaagtaatattatatacatgctgctagtttaaattttcaggagggtcttgaaatgaactccatgtttctctatatttaggcctttgtgaaaatacttcctagagtgaccatgggaacaggctctcttctaaactaatgtgggtcgcctcatctcttcttcaccttggtgttctggatcatctgtgattgtcctggcaatctgggccggtgcctgcttcttcaaatctgagatccaaacactcatttcctagaatcatcacatctgtaatttgtcaaactgccctcaagtcctggatttttgtgctggcatttctgaggttgctgttccctccgtctcatttaatgttggtcatggactccaactgccttgactaattcaggatggctgcggcgtgccactccctaacttgtcctctctctgccttttctgtcctatggtacattacattgaagaaatatttcttaacaatattaaggggaactttctgattggttttaatgcctaagaggacccatccccagtgcatccacatccacacgagtgagcagactcttggatggcaggacacattctggagatatcccatccccacgtgggccatgacagacgctgccttggtccagcagtctttcctcttaaacagcataagatgatgtttttgaaaataaaagtgttgtctaaagtttgcttgtaattaacattgattagttgcttaaaatatcttttttattctgtctttcataaataaatcatatttgttacccttggtccttctgataggaacccctgaattcttacaaggaaaatgattgcttattttatacccttccaatatcttaatttctaattgaagtcaataagcacagactttatttagattctgttttattgtatacttcatggaagtttataaactctaaacactatctttgaataacacttttctataaaaattcgtagtgttccttccatctattcactgctacatatcaccttgattcctctggagactttatgctggacctgatgtaatcattgcagtttttctatgattcatcctcaagctctatttttcctattttagtgatatgtcctacaatcagaaaaaaataatcaaattctagttgatgttgagaatattagaattactgcatggtttcctggggaaaattctgtttacacatattattttaaatatttccttctgttgctctttagtaccttttaaatttttccttctgttgctcttgtatatcttgatttcctattgttcatatattagtccattctcacactgctttaaagaaatacctgaggctgggtaatttgtaaacaaaaggggtttaatttgctcaaggttttgcaggctgtacagagaacatcatgctggaagctgcctggcttctgcggaggcctcaggtaactttcagtcatggcggaaggtaaacaaggaatcaacacttcacatgcctccagtaggaggaagagagaaagagcgagtgggggttggcggggaggtgctacaggcttttaaacaacaaggtctcctgggaagtctgttatgagaatagcaacaaaggcatggcaccaaaccattcatgaaggatccacccccatgagccaatacttctgccatctccaacattagaggttacaattgaacatgaagttagggtggggaaatggatccaaaccacatcagttgattaactcccaaacttacttttggtattaattctgtattatcagaatgtctatatgtctgcctggacatgatgatattcttttttataaagtactttatttcctatatgtaaaaaaatatcaagcatattactctaaatggcattgttagaggagtatacttactaccataattaatttacatttacatgcggatgtttccaactggaggtgggattcaagaatgctttggttctctgatcttactcatggatttccttcagttttgagagacctgccctcaattactataacttgctcaggaaagtaagattcaaactgcactgttaatttaacattgccccattcgcaaatgctgtctatttaaaaggaaagaaaagatgattattttatttttattttttgagacagcctcgctctgtcacccaggctggtaggcagtggcacgatattggctcactgccacctccacctcctgggttcaagtgaaccctctcctgcctcagcctcctgagtagctgggattacaggcatctatcgccatgcccagctaatattttgtatttttagtagagttggggtttcaccatgttggccaggctggtcttgaactcctgacctgaggcgatccacccacctctgcctcaaaaagtgctgagatttcaggcgtgagccactgcacccagccaagagtaggatttttgtgttagaaagcgtatttaatagtttgggcactggtgagtttcaaaagtaattcacacaattaaatttttatttttttaactttattgggaatttatgacatggcatgtagattgataatattaattgcttccttaatatgattatatcagtatttaagggaaatgggtaatgttcatcataagagtggtgcttatacactagcgtggcgtgcaaagcctgacgataaaggctgcacaaacacattgcagtgctcgttcaataacccaaaaggagatgacaaacactcctgaggaatccttggtatcctgatatagacgagaaaggaggattcagtgtgaaagtaaaagtaactttctttcaactgaatcataaaaactggttgaggaagcaatctgagagtattctttatccatgaacacaaagaatctctgtgctgctctggggtgcacaggcctcccccaaacagcgatacgttagtaaagcaactgctgcagaaacaaggagctattgggattttctggtcagtttctgctttcctgaaacaaaaagccaccagtcagtgagcttagaaggcagaactgcaagtttataaacaccaaactgctagcttggtgtagattgagtatccctaatctataattccaaaatctgaaataccccaaagtctgaaactttttgagctgtgacatgtcattcaaaggaaaggccagaaggaaatgctcacaggaacatttcagatttctgatactttatttttaattagggacactcaactggtaatatatatgcaaatattcccaaatctgaaaaaaatctgaaatctgaaatacttctggtggcaaacatttcagataagagatattcaacctgtatgagcatttcttgttaattggtcagtgctagaagtcatactcatccatgtatctttaaatgtcccatgtgttatattccagcaatgttgcagggatgaagtattgtaagaaacccaatttcttacgttattcatcattaataacaggattaaatccacatttcatggaatgattcagaagcagacatacatatcaaacttaggaaatgttagtatccgaaattagatgagtaccttaagccctggaagactgatctgttagccaagaggttcttccgggatctgaatccacttcatctgaattcaagcctcaaacttaactcaatgcacatcctttcacagatacatttttatggcttcttttctgtaccttcagattccacatctttacatttttctttatgataaaaatactaagaaaaaattttaattcaaaacactttgatatttttcaatacactttaagacatatgtgactgctaaaaacttttctcaaaatatccatgctgtaataccagatcctgtgaatgttatattatgttttgctccatgaccggatgacgctcatgatataattaaagctataggccttaaaatagggagatcattctggattatcagggtggacccaacctaaccactcaagtcctcaaaggccgagaactttctttgaatggagtcagaaaaaaagcaaggatagaagatgcgtaaagatgacgtgaaggagagatttgacgtgtaaaggactggttcactgttgctgacttttaggatagaggagtgtgaggatttgaggagcccaggctgctgctggaagcagagaatgatgcgtggacatcagccagcaagaaaacaggacttcatccctaccaccacaaggaactgacttctgctctcggtggacccaaatgaccctggaagcctattccccgtcaagcctgcaggaagaaatacagcctgccgatacctggttttagcccagtgagaccgacgtgggacttttaacctgcagagcagtgaaacgagacatgggtcttgtttgaagccagaatgtttgtgatcattgttgcaggaattatcacgagatccccgggatgggctagagtagcagccgaggggcagattctggaggctcccttcatgcccaccgctttgagcacagactccctcgtggattaaaaccacaacagaaaaggtatcgttgatggaaataaaaacaaactttgggaacatcagggatgtggaaagtcaacaacttgcgctgtgaaatgacagccatcatctctcatatagacttctccctccgctagcctgacatgctggacacaggggacacgggtgaagtttttactttgcgtatgttttaatttgactgcgtagaaatcatggtgttaatcaggaattcacggacgtttcaacatttaattactcaatatttcaacatcccatttcttttcaggatttcgttccttagagtggaaaatgcctagcagcaaactaataacttctaaatgaatcagtaatgcagcataactgcgcattctcacgactgagcttcgcacggaggatgtgtatttaaagtaatgttttgatttggatttgatattttaaaatggaatgcaagcttctctgcagtagcaatgcaatttccctgaagagggcccaaagcctggtgttctttttaatcgacttatttattgtcagctgggagaaactttaatacaattagatatggtagagaacattggtattagaaacttggaattacagaatgtagactgacttcctcatccagctctgcctcttgaaaattgctaattttaggcaaagcggcctccatttctgggcctcagtcttctctgtgtaatgtgtgtttaaactgaatcatatcttcaccaattttaacatgaggttatatgttgagtgctatgagttatttacaaatcttgaatattaactccttatctgatatatggtttggaaatattgctttctgaatctgtaagttgccttttcattttgttgattatttcctttgctgtgcagaagctttttagtgtgatgtagtctcatttatttattgtttgttctgtagcctgaatttttggtgtgatatatgggaaatcatcgtcaaggccaatgttaacgagcatttcccctgtgtattctgggattttcatggtttcaggtcttatgtttaggatttttattcattttgagttgatttttatgtatggtataaagggtccaatttcattcttttgcatgagaaaatcttgttttcctaacaccattttttgacaagattattctttccccattgtatcctttttgtactcttgttgaaaattagctgaccatatatgcttggatttatttcagctctctattctcttccgctggtccatgtgccttttcttatgccaatgccataggttttgattactataactttgtactataattttaaatcaggaagtgtaatgccttcaacttttgatttttttctcagaattgctttggctatttgaggtcttttagggttccacacacattttagaaattaaaaaaaaaattctgtgaagaatgctattgggattttgataagaattaggaaatatatataatatataaaagcttaattacgtactacatatatatataatagcttaattacatattatatatatatttctatgtacatatatagttgctaattatatataatatatattcccatacacatatatatttacaaattttatatgtaattaggaatacatatatgaatatgtatataggaatatatatatacagtaatttataagtatataggaatataaaaatttatatataggaatatgtattgaatctgtatgttgcttctggtactatgggtattgtaacaacgttaagtattttgatctatgagcatgaagtatcttttcatgcatttgtgtcctctgtgatttatttcctgaatgggagaaaggaaccggagtaacagaataatgtctttctgcaaaaagggagggagagagagtttctgtccagcttttgcttttgagagtaaataacttgttattgttcttatttttaatcccaattaatcatgaggattcatgatttttattaaaggaaaaaatgatgttagtggtgggatgcatatattctttaagagaacataataacaacaacataagctttttaaaatgccaagtagaaaatgctaaacgtggcaattcacattgtaaaaggcaagggaggggcagcaggctgtgccttgacttacctggtttggacttcacttcgtttcccacctcctatgcaactgacgtgcagctccacaaatccgtcagcctttccaagcctcccgtttctttttcaacagatgaaatttagatcagaaattatcttagaatattcattaatttacaatgcttattttgcaacattggcaaaattgctgtttggtgacataggtatttttacttcaaaagaaaatattctaagtatttcataatttttttcaaatgttatattaatacataggtatttatcttcataagtgatcttcagataataccttattctaaagttttcccaaaatgccaagaatagtaaaattgcacttgtttgctcctcatgcataattccctcattgaataaaacccatagtatacttacttaaacggtaattgtagtagcttattaatcacactgagaaagattccttcaggtgtactttcaggcactcaatttgttctggctgccttttccagtgttttatatgcatctcttcatttcatcttatctataaagccatgaggtatgtggtgttattagccacatcttacaaagctaaaatcaagaaaggtgaaataaatggtcaaggtcatagagcaagtagattttgaaccagatctgtccatctgcaagccccaagctgttaactgtttgcctcacacattctaaatgatattccccgagatggctttgtagtaccttacagtcaggtatattggtctcttcttcacatgaaataacagtttagtcacaagttaatttatttacctgacttttaggtaaatggtgaggaatcaataacgtctatcaagattgctggaagactcggctaggaaaaaggggagaagtggaagtcatgtctcagccacctccccttcccatatgaataataactgcttctatttccatttgttttattaattcctctcttcccataagatgtgcctatactgtaaacaagccagtagcatcactaaggagagggacactcctggggagtttggtgctccagtgcctcgggtaagtgtttgggaacgccaacacctttccctcccatctgtgattgactgtactttgcgggtatcaccccttccacgcagagaagaccaggtaaacagaacaaatcagaaacagctctgagctcgtgcaatccaaagcattttctacagaagaggctcaaacaaatgattaccacagagtttcatcccaaataactcagctaaggagctaagcaccaaggcctttaagagaatcaactgcaaataatgcatttttgtttccctgacgtttaacacagtcgctgacacccggcagactgtatggaaggattttctgaatggaaagaacaggaagctttgatggacttgtcttcctctgtgtaccggctcatgttacgatcataggcgagtatacgaatgagtgtggtgggttcttacctgtgctctctcggaggttaggggctgacatgaaggaggagcccacagagcagcactcatgggaagctcattccaacataaaaggcatcttcccaaagtcatccatcaatgtcctgctaattttcaccactagttttgttttccaaaacatctgtttataattttcttttacagttatgagagaacacataactgctgggtggaaggtcctatgcaaggggctgaagacattaaaaagaagactaactcaacgcatgtgtctgttgaacgtaaatgtgaattgaatgcccaccatgctccacactctgtgctagattgacccacgccctcgagtacgaaggatgcaaaatttactttccatttgttttattaattcatcttttacaataagatgtgcctacactgtaaactagctagtagcatcactcaggagagggacactcctgggcagttgggtgctccagtgcctcgggtaaataagtgtttgggaacaccaaccccttaagtaagcaaataattgcacaaaggataaataaatgcaaaatcaagcctgagcacagaagtggtgtttcatccagcctgggtacctgtgaatgctttcataaaaaggtgactgtgggtagctaaatgtagaataacgaaagacgaagaagcttaaagtaatagcaggtcgcaggtcctagggaggactgtgttgatgaatgcggaaagggaggagaggccccagaacacacaggacaggatggtgagatactaatccatgtgggggtaagttggtctcaggcaggtagaccagcagccagcggtgagggaggcagagccccagtgagctatgtgcgggattggtcaggatgatgttttaatgagaatgatagtgcacaggtaccagaataaaaagaaagggattatgtttcgtaaaggcaaatgtgattttcttcacaagtctctacatttgaaaataaatgtctattttctatcaccatgatagtcaactctacttgttttaattggcatttaaaagttttgtttcttttcaccttgcatccatttgggactcgacagtgtacatctgcaaattatggccttcaataagctaagggcttttcagtgttcattaacatggtatgtccaaactgttattaacccactgcatcgctttgtcgaaatccaaatcatttttagatataaaaagttgggaggatttgtactttagataacattataaagcagtatttcctgaaaggtattatttagttgtatccatagtacatttttccaagaagacaagagctaagaaatattttcttttttagactatcttcttatcttaactcagtcaaagtgtctctgtacatatttttaatagggcctaatcttcaagccctgcggaaaatatcaacataagatttaatgtatatttatatatttatacatatgagaaatcataagaaatcatggttaacataatgtccattgatgtaacatatgtagaatccaactctcattgtgcgtacaaaccttcataaatcaggcgtgaagaaacaccgtaggattagtggaggttctgtttacttggaagcctgagttcggagttcattccctcaggagccaccatgggctccatgggagtgcctgagttatttattattaattgattttgttgctttttcattcagtaaacacgcaataaatgccctgctgcatgttgggcaagatttgggcagaaagcatatttctcaattatcctgacaatgcaatgcagtgaattttaggtcgttgcatagttgcctgactttctggttgcagctctcttcttttctttgtaaagcacgttagccttctgtatatattcgtgatcgaaggagaactctgtctcacggctttggacgatgttctcgttcaatccacaaacctaatttcttcttgtgtcctaacaaccttacaccaggcccccacatcatgcatacatagttggctcaccgaatgaaaaaggtaactagcaggtaagatagtcacgacaggatattctgctactccatacctcattccacttgttgccaacgcaccagcacatgctctgttagtaggcaacatatgttcatggaaaatgcatcaggtctacaggactagtacacaaagcattgtacattttatcaaaagtttatttggctgtaaaatattattaatgtaataacctttgaaaaaatgtctttcttctagctagatttccacatagtttccaaacatttatgtaaagattaaaaaatatatatttgaatgaatgccaaactatgtaatacattttttaatctttacataaatgtttggaaactatgtggaattagctaagctcgattcttcaaacccttttggcatttaatgatataaatgtttgtaaatcaacagattagcttctgggccaagagaaatcagcccagttactaagctctctctaactattgttaactccacatccagctacctttcatcaacccccaggctctctctattatggaaattatcccaataatttaaaccccaactaaaattcctcctcttgatgcctgcccaattgggcacaatctgaattagccactccttcgtttgctccagcacagcaagtttgcttggatatatctttagtgagcagttttctgccttgcatccaattttttctcagctgctcaggaggttgatagcattgtccatatctcagttgatcaattagtgagttatttccatttctttctttgccttccatttccttcccagcagtataattttaaactaaataggcatctgcaaacactttttgaactgaactgcatttaattgaattacgctttgaaacagtatacagtgaattatcttgaaagactataatcctcaatgtattatctgacaatccgatgatgtgcttcttcagttttgtggagaacaatgaagtgaaaatgatcccagtcacagaagggattgctacccctgagttagagctgtttaatagctaaactctttgtgtggcacatatggaaagtcattattgtaagattcagcctaggtaagagctatgccattttttttatgagacggaagaacacagtttctaaaaaataaagaaaaaaagtcacgagctatattaactgtgtgaacatcagagggagacccaagatttgaacccagtgaatgagcccatgcgttgcatacctgttcctcatgctgtgtgatagctctctacataggtgcgaaaacatgcagttgcttaattaaacaagaaatagccattccagggtattcaataaacagctctagaattttaaataaagagtgtgcaacatggaaattaccttcaaataaccatcctcagcaaaggtttttttttgttgttgttgttttttttttttttttttttttgagatggagtctcgctctgtcgcccaggctggagtgcagtggcgcgatctctgctcaccgcaagctctgcctcctgggttcacaccattctcctgccgcagcctccagagtagctgggactacaggcagccgccacaacacccggctaatttttcgtatttttagtagagatgggtttttttttttttaacaaatttttatgttttgaaaagtgggttaagaacaccaaagagaattatctaaatccagtagacaaaaatctttccactcttttttagaaaacagtagtttaaattgatatttttagagagcagcttggctggtttccaatttgggcagaacacttaatttgaagaattccattccttggaatactaattgtcttctcgacttaatacttttaagaatacagacgataacgtaaaattatcttcaatttgtttgaatccaaacttgataaaattgtaaaaaagtaatatgccagaaaattattaatctcatgattgctcctttgtgaattgatactaatttctaggttctaaatttatacattttgctctactatatgttttcaaaaagatagtctcacctctacccccaatattatagagaatatatttccctaatctctgtacaatacgactgtctaacttttattatctacctctgaaaaacacatggtcactctcatgatttcagcagtgggtgctccttagagaaagcaagaaaaacaagaataatgcgaaatctcatataaagtagattacctctctggaggtggagattgcatagatgatgcagacagagtgctgtctgttgccagcgtaattcatgggcatctagcagctgcttcttgtaagatctaaatgaaaaactagacgttggttttctatcagggtctgatattttgacatgtcataagtggcataaggaatataatttgttcagactcaatattttgaagtgctcagggttatgtagtcgtggcttaatcatgtattttagttttctttccgttcaggaaaatatttcaaatggaaattaaaccatgatcctttaataattttaattgcagtcttttagataagttaacatatagttagaaacgactgccctgcctcttgaaatggtattccagaaccagtacattgcatattttctgcttaataatatacttcaatcaaaacttgcttgaaactcaatctttatttatatctcagtgaccatttaatccattaagtataattggtaaaatgaggtcaaagagtggaggcataagtcattcagaaaatacgcagcaagtaagacaatagatctgctctttctatggtgccccaaccatagaaaaatggttgatacattataagaagtcatcaataaattattgaatgattatggagctctcatcatgtcactattataaataatgcacccttctttgtaagtgacctatattttactctcagcacagactgaattaactgcctaaaaacctagaacaggaaggactgtgaatgcaataggaaatcttgctgtgataattggggatgagatcattcaggagggaaagagttactttatatctacaaagcacatgaaattcacgaaggactgttcttcctttgtccaaaagagttttcagaaagaaaacacggaataacagttttgaagtcaattctacccccagatctttaagctgttaaattgatcgttgacagtttttatttcctgtattaacctcttcgtctttgtaacttcatgctgagtttggtatcttttctgtccattcaacaatttttgacactggatgttacagctgtaccctggaagtcttgctaggggtgcagggtaaactcacagtctgtctttgcagagggcttccttatctgtctcctcccacacgccaccagatattgagaaatataagccagtctagacttttaaaattataaccctacctacaatgctgctatggcagggtgtataaatgagatgcctaataaatattattaactccaatacataccaaagaaagatcttttcttcgcgttagtaaatggtgtaatttagatacatttttttggcctcatttcaaagagctcagaggagattcaggctgcaggagcactgaattgagatggaggaagcacaatagctcgctctggtgatgcatctgggcctgaataatgaccttattgatagagaaccacacagctacagcagaggtggagacgctgcgtcctatgcaaatgcggggcccatcactcaggctcagagggatgcactggttcttcctgtgttgatgggactatgaatttttgaaatgtaggttacttttttgatgttttttaggagacatatatgcttacctatgtaaatttgatatctgtaatttaaatcacagcatgttaaataactgagatgcttgagaaaatacacgtttgatatagcatgaaaatatatgtaatagctcagaataccgataaaatggattttattaaatgtatagcagtaaacaaagtttactggtataaatataaacttattaaatgttataccagtaaacagctattctttctctctccccaattacccgtaaaccacacaattatcccattagtttagattttaaaatagcgcaagcaggtaccatgcagatatgattttagcacaacaattataaatatacgagatattttggttctcttttgctaggtggtgacatcttaccttttacatttatttcagttccattattttataggggaaattgagtttaaaacaccagctactatacttacatcatttgagacttatttggtcttaatcagtatcctgagtcttaatatattaaaagttgtaattgagttttccatgttaattttggttgcttttccactgggaatctagatagatagatagatagatagatagatagatagatagatagatagatagattgatagatagatagataggtaggtagatagatagatagatagatagatagatagatagatagatagatagatagatgcatggtactattttgctattttatttactaccaggtttattcacaatattaagacaaaaagataaaacaagttacatgctcagtagttaaatataattctgccctaattcattacttcagaataaacagtgcatcatttaattgagcaaaaacacctaattattttaataaaggtagtctatatgcttctgaattataatgatttcatttgggagtgttaaagataaatggtttataataagaggtaaccatcgcagctatgttaacataaggaatttcaaactctaagtcagagctgcccaagtacatatacaatttatgatgaaactacatatgcaatattaaatgtttagtattcacactagaaattataaaggaaacaggtaaaatttatttcagcaacatattttatgtaattgtgtgtatatatatgtgtgtatatatatatatacacacacacacaccaagtaacacgatttcaagatgtaattaatgtaaaaattgacttttacattttgtttccattagttgttcaaaatcccttgtgcattttacactgaccatgctttcctgttctgaagagcccactttgaatgttccatagtctcctgtgacctcctggctactctggtagacaccaaccttcagctagtcccttagatttcgctttcatagtgacttttttcatttcctttacgtgtagaagactcttttgcatattcactgaatacatttacctgcagtctgattaacaaacacatacttctgctaataatcactctgggctccgagatacaacatactgtgtattctgacaccaaactgctactcacaatgataaagggaggtgagtgtggaagctaataatgcaactttggtctgaaataagtcaataaattataaataagcttgagaaagatatgctaccataacttctgctgcacactttctaaaaggtcatgacatgagttgtatattacaggcattatgattattctatgggaattccttcctaatgcagcagatctttttgcgtgtttttgtttttgacagatctaaatttagttctaaaacttagctgataaaatactttccccaaacttaatcattattacaaaatacaccttttattagagtaaatttgaagaatatgaacaaaggaaatagacaaaatgttactcatgataccagcatacttatacaacaatattgtgctgtattttatatttttctattttttcataggtataattattctagaaataaaaatattcctgcttgccaataatatatgtctaaagaatattcaaatttaaaagctttctattgattgggaaattaatgggttttaattctcacaggattagtcagtagcatattaggcatttaggaaatgccatggactcttctagccacaaaggtatcataaagtcagctgagaattttaatctcatttgtgcagcagacatgtcctcgattcaccttcatgttgatttcactaggaaaccagcacagaagtttataaggattagaagaattatcttcacatgccaaaggctggtatatttgcattcctttttaagcaaatagtactctaaaaatagtgcatataacaatagataattacatagatttattagaatgcactttgtggttcactgatgttgcagcctatgactattgcagacatcctgtgtgagccattaagatgcttagatctcatgccagtcagaatgatgcttattaaaaagtctagaaacaacaggtgctggagaggttgcagagaaataggaagacttttacactgttggtggaatgtaaattagttcaaccattgtggaagacactgtggtgattcctcaaagttctaaaaccagaaataccctttgacctagtaattccatgtttaggtatatacccaaagaaatataagtcatgctattataaatacacatgcatgcctatattcattgcagtactattcacaatagcaaacacatggaatcaacccaaatgtccatcagtgacacactggataaagaaactggtacatatgtactatggaatactatgcagccataaaaatgaatgagatcttgtctttttcaggaacatggatagagctggaagccattattctcagcaagctaatgcagcaaccgaaaaccaaacaccacatattctcacttataagtgggagttgagcaatgagaacacatggacgtagggaggggaacaacacacatggggacctgacagggggatggttcggggaaagggagagcattaggaaaaaaatcctagtgcatgctgggcttaatacctaggtgatgggttgataggtgcagcaaaccagcatgccacacatttacctgtgtaacaaatctgcacattctgcacatgtacccttgaacttaaaattttttcagagatgctcagatgccattggataatagcctcttgcatgctggccctgtccactgccctttattggcattgctggctgctggggctttcagaccagatgccctcttggcttgtgaaagagcttccttccctggtggcatccttcctgagggcagtcatcatccaacgacactgatggtgaggttaaagagaccagagcctctggcctcaagtcaagacaacactaacaagaattatagctgcaggcaggctgaggcctttacaaatgtgtcaaagttcaccttctccctcagcccaaatgcatttccctcactctttaacagatattgctcccagagcatatcttaataacttttctgcacatcaactccatctccgcatctgtttcctggggaaccttatttaagacattcttacaaagtcatgcaatgcacttcactctgtgcaacaggcaaaccctccaccgtctgctactgaaatccccctcatccctcaccactgaatgatgtggttaagctttgtgtcctcacccaaatcactttgtgaattgtaatccccaggttttgagggagagacctggtgggaggtggttggattatgggggaaggttctcccatgctgttctcatgacattgagggacttctcaccagatctggtggtttcattaatggcagtttcccctgggctttttactctctttatcttacctgctgccatgtaagatgtgtccactattccttttgccatgattgtaagtttcctgaggcctccccagccatgtggaactgagtcaattaaacatcttttgtttataaattgccaagtcttggtatagcagtgagaaaatggactaatacactgacgtttctgcctctcactacttccttctagaaggccctactgaccagcacagtccaaagggatctctttcttttctgagctccttccttgctcacgcttcctttatgtcacctttatgccattttgtgttctacaatctatggccttgctcattctaccaggattgggtgcaacttgaaaatgcataatacatagaggcaaattctaaataacacaaagaatcagaaccagcgaattaagcataacattcaaaaggcaacgttgggaaacagctgaaatataaatccttcattatagtcggtgggcttcctccttacccagataaagacaggaacagcatcagagccaggtaactcttgttatcagaaggaaatgcaaacacctccaagcagaaaaacaccaccattttggttggtcaatgttgccaattatttcctttggttggtttcagtggaaatttctcacctgagaaaagtaacgcagagagaaggaaagaagatatcctaaagggagtttgtgcagtaaatcctgtctcaaggataatgtggtgctttcttctcttttcctttttttttttttttttttttgagacaaagtctctctctgttgcccaggatggagtgcaggtggcacaatgtcggctcccttcaaccgctgcctcccaggttcaagcgattcttctgcctcagcttccccagtagctgggattacaggtgtgcgccaccgtgcctcgctaattttcctatttttagtagaaacagggtttcaccatgttggccaggcttgtctcaaactcctggcctcaagtgatctgcttgcctcaccctcccaaagtgataggattacagacataagccaccatgcccagcataatgtcgctttttacacaaaattatgatgtgttattcataaaagctgaagagagcacataatccaacttggtagagatatgtctcctgtaggctattgctcagacttagcctatccagaatagtctgtgtcacctacatggtagggatgcaaatcccagttctccctcttgcagtgtgcctagctgcggtactcattatctgtttgatgttgaataagtcagttaaccttcctgctctccaggatcacagctcataattggtgactattgtatagatgaacgagtttttgtgtatattgaatcatcttaaagactgagttggggcctagctagcacacaggagaaattcaagacatgatagccaggttatgattagtcacgtatatcttttatttccattatcattttgcaaacttttaaaatgtagtcaattgcaagttgttttctctaaggagaacctgaagtaaaacagctaaactaatattgataaagtaaatccagtcatgtttatagaagtgaaatctggttattcgcatctattctcagtactaatgtgacttatgtttgtgtttgttctttgtcctacttatcctgtttcttgccatttctgtttcagtttcttaaacacaatgcattcctgcatattgtataagaacagtctactaataaaatctaaatatattctatatctgcactctttcctcaccagcttatgtgtttgaacaggtttcttttaaaaacattcagctttcacagctgtttccggttaaaggatgatttggactgccaagtttgctttcaggttaaaaagtgaagtccaccctttttcagtcactgtgttatacctgggcccagctcttctattatccagcagacatagaaaatatagacctaaaatgcccaagatgactcccaggaagctgctacatttattttacctgtttcctgtaactccaaaagaaatatggaaccatggggtgaaaactagaaattgactgtctagcttctattttttctgatcctccagggcgaagttaatcctggagtgagacaattagtgagccaaagtgaagatacatctgcaaaaacaagtctagaacgcatgctctatttcaatagcattatacatacctcgttggagtagaccagaataatattaagcatggggttaaaacaaatattatttacatttatatataatttatttcctccccaaattaacttttagcgtttaggaaactggactgtcatgatgaactcaccactgttcttcaacttggtcgggtcagaaaaaaaccaagtgttacttttaaaaatatggccagtatgcctgaattgatgagttatggtgtttctggaaatcttcaatatttaaaactttctcaattttgcatgatggcaatgtgattttatactagctcttttctgtataacccatttcatcatcatgatgccctatattatgctagatgttaaatagatcaacagttttccagaaatgtgtgtgcaattatagaattcataaagtttaattgatacagaatatgcttactatatactcctgtgaaaaagaattttttggaacatacatagaataaaggtctttgttttaaaaaggttggagatttagcatttgtatttgtgaactaaacaattagcaaatgacttaatactcacacatactaaataattcatcatatagtttgattttgttaataatacaatgaaaccagtgttttaggtaatgtgtagagttcactggaaaggaaaaaactgaaggccgagcagcccattatgagtttctcacgttggaccaggttggtgtggtttcatctaggagtgatttaatgtaacaataagatagtgtcgttaagaatggaaaaaatagcgttcatgaagacattttggagggagattcaaaaagcaatgaatatgtaactctacatacagaaaacggaagcaagattcaaaattgtgtgaaactttaactgcgaattattgaaaactaataatgccattgacagatgtgtttggcagattctgggggctggagacgatgaaaagtaactttccatctgataaaatcaacgtgacagtagaacatcaaaaaattacatcaaatagaaaatcaggacaggtgtataagacagagttgaaagcaggaaacatcaattttaacgttatgccaaaaataaatgtcaatcatagaaacagtaaatttatttaaataaaaaaattaagatagtaaataagtacttgaagtcatcagaaccaagtatttcaggagaaagcagcactttgaaggttatagctaattgcaaagcagaagataatatcccaaaaggaaaagtgaacataagattgtcaagtgctataaagaagaaaatatttccaagttgaaggcaaagtcataaatattgtcctacatgagtataaacaacaaagactcaggaaatactgcgtggacatgagatttttacaagagaactttaaaatttggcctatgactttgcttttgcttatttatttaattatttatttgagacagtgtccctctgtcaccaggctggagtgcagtggcaccatatcggctcactgcaacttccgcctcccgggttcaagcaattcttctgcctcagcctcccaagtagctgggatcacaggcacatgccaccatgcccggctgattttttgtgtttttagtagagacagggtttcactatgttggccaggctggtttcgaactcccgaccttgtgatccacccaccttggattcacaaagtgcttggattacaggtgtgaaccaccacactcatccgactttgtttttttaagtcttgctccgtcacccaggctggagtgcagtggtgcgatctcggctcactgcaacctctgcttcctgggttcaaacgaatctcctgcctcagcctcctgagtagctgggactacaggcgcccaccaccatgcttggctaaattattgtatttttagtagacagggtttcaccatgttagccaggattgtctcgatctcctgacctcatgatccacccacctctgcctcccaaagttctaggattacagacatgagccactgcgcctggccctacttggctttaaaaaaaaaaaaacaaagtgtgcagtacatagacgctaattttgggagtgcatttatgctaaacttggaagtgcaaaaattgcatgcatgacacagatgctaatttgggaagtatacaagttagttactacttatttgtatgtgacccagttgggatatgacactacagatcaattaatacctgatgtgggtgggatagcgctgtagccagaacacaaggtttcaagttgaatgttggtcaaattctactttctctaccgggtaacagtgcaatttctggcaattgtcttcttagtcaatcttattttcttctctgagacatggaaatggcagatcccgactgttaagagttgtagagatgaatggtggagtgcacaggtttcagcccatgctttgctcaatcagaagtgtctattttattgctaccaccaagaataaatgtttaatgtaacatacgattcatatttcacatttctaaatatggtgagcaacgcatacatttttccttttatgttatgtcaatgttaacaaccttcaaagcgaatctttagctgggcagactatttttactcttcctgtatttgaagctgttcatttgcttttttaaattggcagcacataaagcatctcgcatgtgctggtaacagatgaacaggaaaacaactccctgccaccttctagcttagaagaagtaaaggaatctagttcaattatcacagtgcgaaataataacaggatgaagaaagtgcgatggagtaaaggaggaggcagtggtggggaggaaagggaatgttcccatcagaatgtaaactgtttatacttgagctctgccttgaaggtggtattagctgttaaaggagcagaaggtcagaagagacaccagggaacctgagaagaaggcagcatcaaaaggtcatgtcctgctgcggaacagtgagacgcctgatactgtgaggatgtcaggttcatgggtgccaatgagaagtgatggaaggcaggtgcaatcatgaacccaagacttagtataccgagcaacgagtgtgggcttgtacgaaatgaaaaagaagaatggaggggaaaattcataagacacaaaggagtgtgtgcgcatgtgtgtgtgtgtgtgtgtgtgtgtgtgtgtgtgtgtgtgtgtggtttatggtggaaagtagggaagagacaaaaacagaccttacaatatcgacaaaatgaaagcagacagtgctagccccttttatcctggtcatttaaatgtattccaaaattcctcatcatcctctacaatataagggaaattttcttttgtgactcagcccagaacagcagaaaaaagcaaatgagctcatcatggggacccgggccttactcctgtctccattgcctcctgtatgtatgatctcagacaagtgacttcagctttctaagcctcgcttttcttatccataaaatgtttccaaaaatagcatccatcttttaaggatggtgtgagggttaaatgagataaagtaatatgtattttctcttattatgcattggataaataataactgtcgttatataccaaaccatccataattgtattttaaagtaatgattttctttggctctgctgtgagcatcatcacgccactgggaagccctgtaatagcgctggaaagtgtggtgcaggatctttgggagaaaagacatgctgatctgcctagttcctcaacttgttatttcaggaactttgcctccatccttctttctccaggtactgatgccttctctcctgtttagtctgcaatacctcacttttgtccttccacggagcaaatccaagaagcaactttttcgttgccccaaaggtaaaccacccctgtgtagagcaatcccatttcaccatcagattttatctgctggagagaaaatatggcacatcaattttcccctctctcttgctcccctacatttttctagaatttcactcatgcatttaattcacttcgttttcactctgtgcatctgggtacagagttttaactttgagtttcaaagaggtattcacgttttagcccttataaccaaagccactagcaaagatctctccttcatcacccgaggtagtacctaaggttttatgaaacaatcagtcacaagttcagtccatacctatgaccttacagaaattcagagcttttgtttcatctattgttcaagagaataaaaaagattgctcacagagaaatacataaagcaatttcaagcaaggtgaaagagggttattttaaatgctcataaatgaaattgtattgtcaagacaagtacacagttatacactgagacaaaaaaattaagatatgatagtactgtttatgatgaagtgattttttttctacttcctagagaagtggtaaggaactaaagagcaactgagatacatatatatgatatatacatgtgatatatatatgtgatacatgtacacacacacagacatgaatatacatatgtttttgtattaatatatacacagtttgcatatacatatttaatgtagatactaatcagtattttgtgtatacacgcatatatacagtcgtgtatatgtatatattctttgcacttcccccactctcagattacatggatcttcctgactctggaactaacactttactgagaaagtggatgattaattggaaactaaactgcacaccaatgcactattttcggacagagaacatgaaaccgaagacatcatgtggactctgcatgtacggggcagagctagaatgcaaacgcagaggtcctcaatgtcagacaccaagctcctaactccacagcagactgacagggaaaataaaattggtctgtgtttcagagaaagggtagctgaccattaaaaatgttaaaataattcactgagggtgatagtggcatttttcacccttgaggctgctatttatttatcctgaataaactctgttttttatctgtaggtgagattaagctattaggatcataaaatcttggaattaaagggataaaataactttagaaagttatctagctcatgattccacaaaatccaggacactttttatgctatttagggtaatgaactactgaggaaatcaaattaattttatagagatgctctcttttcctgccccgccaccccccctgagacagagtcttgctctgtcgtccaggctggagtgcagtggcgctatctcggctcactctcactgcaacctccacttcctgggttcaagcgattctcctgcctcagcctcccaagtagctgggactgcaggtgcgtgccacaatgtctgcctaatttgtgtatttttagtagagatgggtcttcgccatgttggccaggctggtctggaattccttacctcaggtgatccacccacctcggcctcccaaagtgctgggattacaggcctgagccactgctcccaggcagacatgctctctttaacgatgcacatgtatatcaaactttacctggtgtgaggaacctcctgaaagatttgataatcttagcaaatagccaccatataagggtctgacaatccaggttaaagccttcccttaaagtgtcaatacagacatggctgtaagcaccaacattatgccaggcaatggagctatccaaattagtaagacctagtactgcttctctgggtgttcacagtcccttcactaaatcccaatatctcatcagctatcagtagacccttgatactgaaacaagcataaaaaagcaaccaacgaaacattttatgctaatactacttttttttttttttccttgggaagtaattcggtatttactgacaaaagtcaagtttctattgggaaactcaatacacagtttaatcacaatgaatttgtaataaactagattcctttaattttatttagatgtgtatgtccttggtattctcttagtctcattgctggatcacgaaccactcagaattacttataaagtgaaaaaagatctgacctatgctgataaaattttcaaaatataggaaaatcttaacattaaaatataataatgactatgaaattaagaggcattgcccataagagttttagatattatttaatccaaggttttctaaaccatttaattgcaacacatatttatcctaaggaaattgaatcttgataaccctaaactactttttaaaaaagcaactcaattttctgttcagcagtttctagagaggtgagtaaaagtaaaagtcagggccgggcatggtggttcaccctgtaatcccagcactgtgggaggccgaggcgggcggatcacaatgtcgggagatcgagaccatcgtggctaacacggtgaaaccctgtctctactaaaaatacaaaaaaaattagccgggcgtggtggcgggcgcctgtagtcccagctactcgggaggctgaggcaggagaatggggtgaacccgggaggcggagcttgcggtgagccgagatcgcccactgcactccagcctgggcgacagagcgagactccatctcaaaaaaataataataattattatttttttttcaattaaacaagggttttattaaacaggcacttgagggaaccatgaagaccttggctaattttctattagtggcgcttgacaatctagagacaaaacaagacccgggattttgaagttgcatttctctttttgccgtaaatccacaccctggctttccaaattaccagcaaaacatcttatggtttaaacaatgtgtcatacaggcccagacttacacattttaatgcatctagatggtgtatattatttatgaaatatgtaattattaaaattattgcaatgaatttcttaagttgaaattgctaacttggtaaatttataaattaaaaattactaaactggaattattaaagtgaaacttttgacgctggtacattccaagaacagataattatcctctgtacaagatcattgacattttcctgaataaacaagcatggttttagaagtctagagtaaaataaaaataaaataatacacgtgctaaccacaagtcatcactaatggttcttggaattcctttctcaagaagggtcttaaccttatttccatggccaaacggcaatacctctaaacaccttcagaatatatgaagtgtttacactatcaaggaccgcttagcaactatgctgaacatttaaatggcttttacgtttaatgtaagattttgtgatactccaatgtcaaactaaaagtaaccttggaagaaatctgtagtaaaatttataaaatgagcatattctctctaaagataacatttaaccctttaatgaaaaagttttcagatttgttaagaatattctaatccatatcaatcaatagattttcttttctgtgataatctatgactcatgacaatattagatgtggcagtgaaattagcaaagcgagtggagactgcatgggcaggcgagcgtgcgctcacacacacacacacgcacacaggcacacacacacagttttgggtcagaactggtcaccgtgacaaagggaaaatattaattaatgccagtagcttagaacttattagaagaattgtagtgagttaaggaagcagaattactgcccagtgtctgcagcagagaaccttcagagtaacaggaccggaataactttgttgaataactctcctgaaggggcgtatgttcacagtggtgaactctcccgaaggggcatatgttcacaatggtgatgctaacacgctactaaatacctattcaataattaaccagtaattaagtctgtaaaaatgcattttactttgagtattctttgaatatctgcaactcaggtgtgggctattcaccccctacaaacttgaattttagactaaaaatttaaattctggagacattccagtcaataaataatttagaatgaaaacactatgatttctccccgtgagtcttctcagaatgctgaacccaataatcctgatgtctgttctttgataaataccgtttcacgaacagttacaaagaaactaacaaggaatgggaactgacgcacagccagccacactttccagagtttcacccttacttgggtcataaatatgatactgcagcagcaaataaaatgtgacttccttagtttcagatttaaaaagtattcaaaggagcagaaaaccatgctaagaaaacaaatttccatatgcacacatttccaactcagatggtgcactctggcttctcttgtagaaaggatgatgatttgcttgtgtgctttctaaagattgtaatcggttgcttgaattgcttttcttcttgtttccatttaagagaaaggaatttgagcatgatgtttatgtgccaaggtgatggagtagaaacatgttgtgggttttctctgtgagttggttggtagcatgtcattgttcttctaaggaaggattttcatcagtcatatttcaacagagggtgggggcacagctgagtgccctgtttttatttctacttctacatagagtttggaagatggataacttagtgaaactaatacatcagcagagccaatatacggtgtggtaagtagaaggcagaacatatggtagtttctgcaataaatagtgtatttgtcattgattatcctttgcttaaagcaacaacagatatcctggtgcgtgttatgacagaaaagagacctgaacagttgatgaatagagacatttacaaatgatgctttggctgggtttcgatgttttttttagcctctatcccaggctttacacagtattcgatgtgcttgggccacaggacattggcatctcattcatctagagaccaggatgatggtaggtggaaaagccttgtgccacaaggcatgcaaaatcaacaactgagtataaagcagaaggttgataatgatgctaactccagaataaagagagaagcacaacattcagtgtatttagcaggtgacaatatagtcaccgtaggaggatcataaattaagacaaatatcagtgtagtgatttgctttgggttttaaaatgtttctctacttaggagggcattttctcttctctttcctgcttaaattttctctgacataagtaccaccttttaacacactattgtattgctcttaccaatcttgttagttgtgtgtctcgccatgaaaaccgtatcctagaatattaactatcatatagcaaattcttcatatttatgaaataaatgagaagagcaggctccgttcagagtagaaaatagggcttgttttcaatactacttatgaaaaaggcatgtctcaataaaatgctgtgttcattactgaaggtagaaattctccaagagacaagaaaacaaggactcctttcctctccccctataagtaaagattggccaaatctcttcaacctcttaggagcaggagccgaaagcacctgccattcctgtgtcgtgcaggcagctctagccccagaggatggtgatccattctggtggggaggccctccctactcagtggcttctctgaaccgccttctcacgagttccctgcttgagaaattattcctgttcttccctctctctaatttgggatggcatttgaatcatcagattcattacactagagtgtcccacaattcttttatgatctaagtcaattatgcttttaaagaatgttgtttgcagagtatgtcacatgccaggtatcactatttttctctgagagagaacccacacagttatcttttgatggtatgatgccttcagaatgacctcgctgctgtagtgaaggttctaccggtgactcccaccgaggtggattgtggattagccccagcagctcagagtatgtgctcagcagcagatgcataaatgaactgcatagtttgtgctgcccaggttggattgtataattatcctacccagctgtggtggacaaaatgcatgctcgctagaatagatcacattccttcattctcacttgggcaagcccttcgtcttcactgatcatgtaaaacagaccttttaattgctctcatcaccgatgataaagacacgaatcactcattcttgagggagcctgatattgtggtgagcaagtccacttccattcgcaagaagaaaatgctgcatttgccttaaaatgagatttgcaggataatgaaaaggactaacgcttaaaaccatagcccttgaacccctgccaaagtgcctacagtcgctattctgagtgaattctttcaaaaagggcaccaggctctaagtacgtcacctagaagaagatctagtctggctggaatttgttggccatacgttttcggtgattccatggaaaagggggttttagggcggaattggacaaagaattttggatgaaaaggtgcaaagcccaagaaacagggcccaaagagggcttaatttaacagcaggaggagcacaagtgaagtcacggggtttctgatgtgaggggctgacagtaacaaaaattatcttaataaaaactcaatttcataatattttacagtttagaagattttctttttctaaaccatatcttgattcttagcctgtacttcaaagcgtaccgatgagataccaaatggggaaatggtggctcaaaagttagctgacttgattgcacggaagtggctgagcctggatcaagctcagaagcccttctatacagcagagtgtgagattttctttgcatcttcttcacccctcatttgtactagcatctcactgtacttgtggtagaagttcaaaaatgcgtgttcctatagatttaaatatgttggagagtgttactccattaaagtatgctaagttaatgatagccctcagtagctaagaattgtgaaagcttaaaatctgtgttttctttttcttttatttctacttctctctactctctctctacattctacttctccctctctctctctttatttctagcatctaagaaatgtctgctacatttcaataagtgaatagtcagatgaacaaacaaaagcctgaatgggttcttaaaatgttaagttactctaagaaagaatatatgataccacagtgttaaatagtatctaagagagctttctttcaatactatacatagtcattctttgagagctacatatttatatttaatacttattaaagcttaggtgctgttactaaatcatttgtaactaaactgtatagcatttctttctcttagtaataaaaccagagtgtaatccattaggctgcaatagtgtttttaattttctgccagaggaaaaatacaattctctctaggaccaaaaactgctgagacaactggatagctataactttgtatgtatacaaaattaaggtttcattgattagaacttacctacataagataaatctaattttaaaagtatgaatttgatttaaatgtatggattttgacatgccattcttacgcatttctcgagattttattgaccaaaaactaaatttatataaaaaagaatatatattagttcaatttaacacaagtttattatgataggttgatgtttgaaacaagtgtatgttttcaaatgtgtctgatttgaaatagttgaagaactattttttaaaatgttgatttggatttttatacatactgagccattagaattatggtgaaaaaattcagttcaactttaatgtctgagactactaaattagaaaaacatactttcttatgggtgttttatgttttttactccttggaagttaatgaagaaattctacaagatttcagtgaacaagaaccctagcttcatacactaattagtataattatcattaaaccatgacctgagaaaagcattatgtaaaataatatctgacaaggtccagagactggtcattttcaaaattgagaataatattgttagagttgctcctatgaaaatggctaatttttgctaccacgaaccaaagatattattttgtgtgaattgtaaatcattgaggtagctactctaaatatagacaggtaattcatataccattatcacaaagaaaaacctatgctaaataaatataattcctcacttatggagagcattttgggacagtgccgcagacccaggattgggaagctgtgtcctgcgcaggctagaaccgaactgagaggttggagaagagacaatacgaaacactgaaatggaaagaagttgtggctagcacagcacacacatcagtagaactcaggaaagcaaaatggaagaagggaagttacattaaaaaggcaaagttcaagcccctgagctgtactttccaagtggggacttgcctgtgccccccgagcctgcagaggtgaccgtcagtcagtccctgtgtttggcctggactgcgacgctctttatagggaacccaaagaaattggcgtccctgagcacctctgcgtattagcttttgtattagctcctgctcatacctgccttaattgaatcatcatcaaagccgcataagaaaaacggggctgcgtgtgccagcctggcgtggatgcaggctctagagcgtgactttaacacacgtttgttttagagtccgtcatctcatggaatcactctgggaagagagaaagtgctgtggtttataaacttctagctttaatcggcttggctggatatagggagcaactagaacttgagtgggaacggacagagaaaagtggaccgcaagaagcttgcttttgcgataaagaggttttcatagcacctgagggtatcgaaggcctctcaagtgtaataggcaaaacttcaaggtctgtacctaaaatttatagttcagagaaaatctcctttatacatccagaagtggttagagcagaagaaagctttgactcaaattaactaaactcacaaatgattaaggtgtaaattggaaaagcaacttgtaaaatttgaatagcgtttgactatccagggaatgacccaataatcaggatagccactctctgtggttaatgacggttgactctggcttggaaagaacatcatgaactcaaagcaggaggttcatggtacttgacgctccggtgtttctgaccggcccgtgagaagcgctctactctgctcattcttgacacacgttcattttttgctttgaagataccactccctgtgtttcatgatgataatttccatcctgtgaacgttttttgttgggctgtttggtttttgtccatttagtgttcagaattgtaatggaaatatactgacctgaggatatttcttgtttagaatttggtccttcatcaaatttttcacacattttaaaatagattatgtctaaaataatgtgacctcctctatcaaaagtttggctatttttcttgaaatagattatgtctaaaagaatgtgatctcctctgttaaaagtttggttatttttcttggtatatttattttcagattatatactgactcttagcagagccaattttaatgtaataattaatgtaataaaatacaaacaaaaacacttagaaaatagctgtaattctccaaacacagtgaagcatgtggttgacagttgaccatgtttctcctttagttgtagataatgcacttttggtatcatttatacatttttacaatttattttcagattttttttaaccgttctgatagacatgtctcttataaacagaccattaagttagaattgtaactgcaatttgatatataaaaatgctctacagaaaaattttctgcgatttatataattgggcttttagcatttctgacatggcatttaatagaccatacatttgtttttctttctgccacttgccattttcacatttgcatctttaataaaaccaacctgattgtcaacactgaaaaatgctccatgttaacactacctgcttttggattccaagcataatagaagcagtattaataaaaggaattcaacttacaaataataatggctaaataaaaaaacatttctcttacatgctcagatttttaatttaaataatatatttataaaatattttctatgtacatgtgtgtatatgtatgtgtgcgtgtatgtgaatgactaaaagtaaacaccaaatacctctaatcttagtcataagaaaaatgaccagagtaggacatttatttttaaaacagcagtcttaaatttctcatgatacagtcggtggcttagagatgtgcttctcaaaattcagccttggtcaggtgcagtggctcatgcctataatctcagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcactccagcctgggcgacagagagagactccgtctcaaaaaaaaaaaaaaaaaaaaaaaaaaaaaaaaaaaaaaaaaaaaaaaagtgggtgtggtggtgcgtgcggacctatagtcccagcttctctggaggctaagatgggaagattccttgagcccaggaagtcgaagctgcagtgagctgtgatcatgctactgtactccagcctgggtgacagagtgagatcctgtctcaaaaacaaggataacacccaaactccttaaagtgtacatgaatcaccagggcactgtttagaagcagatttgcatcctgcaggtctgggttggggcctgagactctccacttctaacaagctactatgtcagggatgtgggaacctggagtagtgaagacaatggaaaagatgtgatttactgaacggatcttaaattcctaagtaaactcgtgtgtgttcttgtcatcctactgttcctcaaaggtcctgttgtccaagcctcgagacacatgttaagatctaaaacctccagttcattcttcttattattcaaaacatgcaattatttttgttttgatcatgcttacggattctactataatatttgtgtatgtttatgaaagacataaatattacatatttcaacatttaaaaataaaaacagttatttcctggtcatttagtatttaatcttgtggcaagaataatagtgtcctttcaatatgctgaattagaataatgtagacatagtatggtctgagagaaaaattccctgtttttaaaatgcagtaaggatcttcattgtgatataataaattttcacaaagatgctcttctttaagcctaattagtaaaagttaagtgaactgcacgtgtggcactagggtcttctgttgaaatgcctctgacacttacataagtgtctagtgtgcttgaaaaagaagggtgtacacatttgctctggaaaagaggagatactaggatggatcttgtgagccaatttaatattttcattccttaaagcataaggattaagaagaaaattgattaaagcaattactaggactttcggttctagtaaattattttttatgtgtcttcctgttaatttttattataagaaataattatgtttttaatatatgttaataagtgttttttgttttgaaactttaaagtcaggaaagttagctgttgtggaaaaaaggagcatgatgtctcagggaagaagttcgttaaagttcgtgttctttaagattcatcctgaaacttcagtaggatatcctatacctgtgctttgaaaatatacctaagagaagaggtagaacatttattttgagacaggatcttgctctattgcccatgctagagtgcagagatggctcacttcaacctcaccctccttgagtagattctcatcctcttagtgaaaagccagagagctgcacatactcctcgtagatgtgtcttccacaacatttcatcaattggtgcttgttacgctatctgagaccataataaaaaatgatttaaaatacctttttcacatgagtcttatccatatttgaagacagaaagaaaatttctgtcatttaccattgcactttcctctaaacacatcccagcctgtctctaccctaggattgcattcagtgttgcagaaacagagtaagcaagaaaaaaatagaggctgctatttcctcattctaatactgtatttctacaataaatccttggatttaaatggctttttctgttagctatatcacaacattagtaaaatgtaagaccctataataaagaccttcaaaaatacagactattactaatattattatgtcagaaattgcacatagagattctaagattccacttgttcctggggtgaaaacaataagataatgtgttcgtctcagggtgctcaggctctcattgcacagtcatccctgcagggagggaattatgatggagatacagataaaatggcagtagagacagagagccatcagattctgcttggagttctcagagatcattcccagagctgtggcattcctctgccaggatgctgaagctcagggtgggaaaggaagatgcctgggcaggcggctggccagtcagctatttccctagctcagactatggagcttaagttgctgcagagagcaactgaagaagggagggtggagaaacggctgtcaatgctgagttttagaaagatccctctgggaagagtaggaacggtggatgggggccagacatggaaagatcacaaaggaggctgttgcagcaggtaagaaaaaggactccaaagagagggactggagaatctttgtgggaagggatagggagcaaagtaccaccacgagctcctagtaaagtgctagacacaaaatgctagacaaaaagtgatagacacaaagtgtggactgtccgcctgtggcttcctgtgttaatgccatgataaccactgagcatgtgggtttctcggacccaaaggagacctgttctcatttagagtcaaaagatcttctggagcttattatgattttctttaagttattatcattgagtcacagcacagaaaagttttgttacttcatctatcattacaacaaattcaattagataatattcacatgaccttttctctttatattgtagagagttgggaggtatcagatataaggccactaaatagggaatatgactgagctgaacatttgtgaagtttacagtaaggtaaaattcctccataaaatatctagttctgtcaactatggctatgctctgttaatctgtaggagttccaagtgaaattgctgcattgctatatttacagagctgaacttggcaggctcaacaacataggattgctttaatagatagaattattgaacaaatacacgggatctaaaatgagctattaggaagtaaagtgtgtgtatgcgtgtgtgtatgttcacatgtatgtgtgtgtgcacgtgtgtatgttcacatgtatgtgtgtgtgcacatgtgtgtgtttaaaaagaatatatcagttactcacactacattcctttaacttttaacttgttttagcatggaagacttaagattattttcccaagagaaggtatattattcaagcccttcaaaattttggacattgccttctaacacatacacacacacacacacacaaacacacagaattttaagtataatagatgactatatgtagttcctaaataagcaacctgtgtattttttctattctccatctgtagttgaactcagacaggggcatccatcttatttgtttattgtatcaagcttaatcctgtattcagaaatgcataccattaatcattatgatacagcaaatttaattaatatatcaatgaaaatttatataatatactgattttttttactttgtcaaaaaatgacagaaacgatgctgttggaaaatgtaattatatttaaaatacagatgctagatggtgatatagttaggctttgtgtccccattcaagtcttatctagaattgtagttcccctgttatgggagtggccaggtggatgtcattgaatcatggaggtgattttccccatcctgttctcctgatagcaagtttgttctcatgagatctgatggttttataaggggcttttcccccttcgctcagcccttctccttctgccaccatttgaaaaacatgtttgctgcccttttgctacgattgaaagttttctgaggcctcttcgcccatgctgaaatgttagtcaattaagatgtttcctctgtaaataacccattctcaagcagttgtttatagcagcgtgaaaatgaactaatacagatggataaatatttgactgtagggacattcttttttaataaaaacggactatttgaaagtctatcaaaccaaataaactaacctgatattctgtttaattctgtttgagaccttgcacagaaaactgtgtgtgtctttactgttgtcccattcacctggtgttggcatgtaatcttatctttgtttttactattaccacttttcttattctctctcattctccaagttacatgtggagaaaggatatgctatcattactttgcttcaatggcaggctgttacctgaaaattaacatttcataatttactttctcgcctttccttcaaacaaattttgctatcaatttccttattatctgggattaactttgttgttgtgggttgcaatatttgactcctcctccctttcctaccatatgctgcccattactttagatgctaccattgtccaaagaactatttgtttctatgtcttctctggcctttctattgcctttgcattgatttaagccattacctattgcttaggtacttcagcagccgaattaaatgatttattccttgcattcatccaacctgtctctttttcttttatctcaaccatttggtaaaaaatgtgtaaaatatagtgctagtataaagatagagatgaagaaggtgagtctttgctggcaataacttccgtgtctataagggaaatcatcaatcatgtgtctggtaatgatgttttatgtttttttttaattgttattttaacttcaggggtacaggtgcaggtttgttaaacaggtaaatttttgttatggcaatttgtggtacagattatctcatcacccagatattaaacctagtacccattagttattttttttttctgactctctctctcctccaaccctccaccctttgaaagatcccagggtgtgttgttcctccccatgtctccatgtgttcttatcagttagctcccacttataagtgagaacgtgcactatttggttttctgttcccgtgttagtttgctaaagataatggcctccagttccatccatgtccctgcagaggacatgatctcattctttttttgtggctgcataatattccatggtatggatgtaccacattttctttattcagtctatcattgatgggcatgtaggttgattacatgtcttttcttttgtgaatcatgctgcaataaacttacatgtgcatatgtctttatgatagaatgttaaatgcaaaaatcaagctataaagaagcagccatgagagaataaataatggaatggtttgctgtgactgagccccaggaattattacaaagaggatgatgatgacagctgataacatttactgaacgcttacataccagctctgcattaggtaggagctattttcttaccccacaaatcagacagcacagtggggaagtgaaggcacttgtttatacaaaagtgttagagtggggacacaaacatgaaacctgcttccaaagtttgcagtataccattttctcccagtaactttttttcttaaattattctttttcctgcgatttatcttctcaaaagttatgcataaaaatcattccttttgataattaggtgtcactgcctttccctgccttttagctccagtacaatatgtgcaaacccattttcctagattgagtgttcaccttccctggggttttcccgcagctgtcatgctgtcatggccgcagtgtatgcttgagtatctgagttctgacttctttagtttttcttgtatttgcccacctgaggggcctgctgcttctctctgttcatgcaaattcattcaccaatttctaaatcattgctctctctctctctcctggaatcttcttggcacctccaaccattgtgatctccttattatctgaatatctccaagaataatcaactacctaaattttcctggatacacaacagagtgtgcagtgacctgaagaaaataaaaagtgtgagaacttttacgtctctttttaaattttttacagcatttttccctgtcctgcacagataattaaacatagagaagaagttaatatttgaaagcattagggtgacagaatgagttaatccagtagaagaaacacctcacagctcgtgagaaacaaagctttccaatgaaaatcaggcatattcatgaaggctaacacagggcaatacaaatgtccataatagcctgagtgtctccagcagctccataaaaatgtaagaaaatcaagctatgaactcagttcaggaaagtgttaaataggataacatttttatgttgcaaccggtggctacttattacctgctcatcagtaaatctctagtaaagcagtagcgtgttgtatgtaaatcttggaccctggaatcagaaaggcctcagttcagattccagaaccaccattgaagatctaggcagccttggaaaaattcctctaaaattcaaatcctcggctgacaactaggaagactaacagtccttttctcttattagggagatattagggagataaaagcaagaagatgtcaagtgttcaaataagtgtctggcacatggaagacatcagtgcgtgctagcttctattagtcttctcatcatcattgctagtagtattatatttagtaattgtctttcacttcttttcttagctgtatgtgggcttctagggaagagaccttaaaaaggtgaattattctgacctttaatgtaagttgcattaaaatgttgcataaagttcaatgtttgaaaggaaatctgtcgtcctacaacacttgcagatctacgtaataatcctctcccttactgaaaaaagaaggttatttggggcagataaattgatgagagaaagacaatgggcttggcaacagaaaatccaggtttagatcctggcttggtaacttggtagctggcattggagatgtggtttaaaaagctagtgaaatctaaatgagaagaccttaggctttttcagtgctgagatgactcaagtatcctctcgcatttggtattagcaataaaggttctgaaagagaagggggcattcctcattggtgagggagcattacctcatatgtataaaaagatcctgaataccagctccaaaataccttttgctcttccctgcggaaactttcccaaattttaacgagcagcaatttgcttctactgaactgacttgttctccatcaattttgatgtgatttcaaacaacccgagcacttctcagcaacatcttataacatccatatggaaactttcccagaatcccaggccataacgagtagtttgctaaagccagacctcctaggagaaggaaatactgtggccagcctgctgctggctggggtaaacacacatggaatcttcaccaaggagagttcagtccacagagccaagactgaaaatacccaggtccttgagaggtcttaaaaatgagagtaaagatggcatgagcagaacatcttcaaagaagtagccaataatttatttgcctatgaaaacaatagatgtatcttttgcttgaacggcccactcatgtcaaatgggtaagagctaagaatcattgttaaaataaaaaaagtatttccagtacctaaaaatataatgttatacagtatagttgtattttgttaaacagcatataatttaatacccagcatttacttatacttcgctaccaaatacgtttctaaatcttcaacagttattattttgtagaaataaaaaaatcttagagcttctggccacacaagaaaagttattagtcacagaattcctattcaacttttcacctttttttttcagggactcactaaacaaaagaaaaattgcacaaacatgcatagaacactcagaggaagctctaaataactatataataagctatactgtgaaattcacatccataaacaataatttgcttttttagtactgctcaatatatcacattttttaaaaggatttaatagatttcttgaaagctagaaaatcaaaacacatccttataccatgcaggggaattttccaggtaaacatatttaaatgtcccagtacaagctctattatatttcaatagagcttgtaaatgtaaatgaaaattttgataaaaataaactcttttgatgtttatcaatgcaataaaaaataacttgtcacctcagtttctccaaatatgttaagatattcttcaaaatatttttgtaagaaggacttctttctttgataagagaatcttcacttcacatgcataggggcataattctaacttcatacagcctcttgctaattaccataaatgctatccttgtctgtttttttccagaattcaaaaagctacccaggtcaatttcagaaatagaaataaattgacttcttgtaatggtcagtgataataaaataaggcagttttccataatttagtagtagtcatgaaggattttgtcgttgttgttaagtttgtttctttgtttaccagttttactttcatgggttcctacatacttctttgttaagtcatagataggagaaaggaaaaataggtagtcagtgaacaaaatacctgttcagatgtgttaaaaatgcagtgtagactattggataaaaatgctttccaggcctttgttgaaacatgtaagttatttaacgtcttacaccacatagctttgtcagtttaaatgggcaatgcactatctatcttccttgttgcaccattgagaggattatgtgtaaaactggcagtcctgtaatagattttagtagacattagctccttctccgacacctaccttccctctatgtctgtttccttctttccaagatatggttattctgggcatgagtcactataacctgctagggtaaaaggctcttgttagagttagggtcattggcatggctaatttgtgcttgctttgagggcaacatttttagtcatttatttttccttctgcatattgttgatgtttctcaaatactagggttcaggaaatgaactttttgaattagtctgttttggaatgtaatgttcaacatggtttcgcttttttcagtacttggtagacattgactgaataaatgaatgaaggaaatgaaggaatgaatggttgccttctattctaatttgctttaatatcagcattttaaataccaacctcggtcttttttctagttatttttcatttggggatttttttttttccaaagaaaccgtgcaaatgaaagaggagcgtagccctagagatttgtgctgaggtacaaatgcacctgttccctccttctccgcccttgctgcctcccgatctcctctgccatcccagcaggctggacatgttttagggcccatataaatgcttgctaaatgaatgagtgtggatgtcaactagcctgcaaagaagttccaagctcatttactgcctggagttactaaatcctggaggatttgggcacaattagagctataaaatgcctgcttagtctttatcaagccaagggttaaaaacgatgtaaactacaagggaagtctgcttagtcagagcaaggatacagctggggcagatgtgtggctgcccagatgagctcacgattcccaggggccttgatttagtgtcttctgctgtctggggtggtcatgaaagcagtgcttctctgacaggttgctttccattagtacaaataaaattcaattgcattgcaagactggaatttggcaaagttactcgaaaagtaatcgatggtgaaaatgaagcccttgtaagtaattcttgttcttaagcacttgtgagtgagaataaatgcttggattctgcatgtccagagtgagaatctcaggggaaaaacactacacacacacacacacacacacacacacacacacacacgcagaagaaatttaaatctattaactcttcaggtgtcttaatttaacattaaggtttctagaatctagcagagtgtctttcaattacaccatatgcagtttgttagagtagaaagagttctacccatggggtctgatacatctgagttcttgtctgcggtctgctaccgaacgcttttgcacactgggtcctgggaacattattagaagcctctgaatctcagacttgccatctgtgaaatgaagataaggatgcgggactgttggaaagattagcaagagagatgtaaagctacgggcatgggggaggcatgcagtcaacactggctcctcagtcttctcgttttttctctcctccttctcataacgctggcattcttgttaatactgctgctgttgtgatcgttctcactattattatttttatctttggccctataagaatgtaatattagaagagacagttagaataaaaatacagtactaaagcccatgtgagaagacaatatacacaataagaaaaacactgtgagttgttcgcccaaccctaaataaatagagtaggtggtagaagccagcatcacttcccaaactactagagtaactgctgtggctgctgttcctgggtcctcgtgaacccattggagctttgaaacagtgctagtcttcagtttccaaatgatactcatgcaaagtgtgcattcccacctttctcctggagtgcagggatgggttgatttttattcagttttattcctcacactcctcaaaatattcaataaacatgtatttaataattaatgaacaaaagaacaaatagataaatggaaagttatgacatcatatatctgaatgaatatttgctcctttccaaggcaagttgtttcaagttgaaatcataaattataaatgaccaagatactccaatacggaaaaatatgaaaagtacttgcacaggtgggggaatgtgtcacatgcagcttgctccagtccctgaatggccggtaagcttatgaggtgggagcaaaaactgctgattccaaagacggatcccatgaggaaggtggcctctaaccaagacaaaagcaggttgaggtgggcatcttgtgtggaggctgagtgggaaaggactgattctcgcttccaaacagtagtggaatttctctttaactttcagttacagctcggaaagttaaatgctactcgaagccatctcatggtttctcatatgggcaaatcaaaagcaggttacagctggtaatggtctctctcagcaggagtcaagacccacagaccctccatactcttcattcgttagcgtcttgggcctagaactttaaaaccatgacatagaactcccaagccttcctaaatgagtaaaatcaccccaataggcaggaacactggccctggttgcctcaggaatgactggaaacaaagcacggtttagtcacaggaaagcctttctcaagggagacatttctcgttacggctcttatttctttagataaagcattatgcacaaaaaccaagaaaatcagcaacttctccgtctctattcatttattcatttcctttattctttttttttttatttgtttttttgaaatggagtctcgctctgtcgcccaggctggagtgcagtggcacgatctctcctcactgcaagctccgcttcccgggttcacaccattctcctgtctcagcctcccgagtagctgggactacaggcgcccgccaccacgcccggctaatttttttgtatttttagtagagacggagtttcaccgtgttagccaggatggtctccatctcctgacctcgtgatccgcctgcctcagcctcccaaagtgctgggattacaggtgtgagccactgctcctggccattttctttattcttaaatctgattattctttgaatgaccccacctaactcaactactttttattcccatatttacaaatttagtttgaatatgttttcatctttcaagggctttctatatagcctgcaacatttctttgaactgaatttgtctttgattaatgaactgtcttcacagttgttctgagttccctgaacataaaaaagtatatatatatatgttttgttttgttttgttttgttttgttttcttctgtctccctcttttccatccctttctttttccacactgagaccatgctttgcattctgggaatctctccaagtacttctcaatgcttctaagtgcggagacgaaaaggggtaataaagatgtcatacaatttattttgttctctggccattctgagaggagttaaaacattaacatgggagcaggtgtgctctgaatcacgagtttcagaatcgggagaggagaagtgatttgtcccgtgtttaggctgcagtgtgtgcgcacaagtcattccatggaaaggatgaaaatcaaaactcccgctgaagtttcagatgaggttcctatcaccttaggaattcaaaagaaagattaggacttaggagtatctttgcttttactgtgattgcaatggaaaacttttatttcattattgattatacatagatccatgtgttaagttgtttatgagatccttccctacagttttataggaactttgagttgtaagcacagctttgaaaagccactggaactttcaaacaacagctagtcttctgttgccaaatagatactcatgcaaagtttgcattcccccctttctcacctgctcacagattaacgtcttttgtttttttatatgtttctctagcaatatcgaaatttgcctaatgcatcattctcaacagcataaaaatgcattatgtgtatttcattcaccttaaagaaaacttttgtgtgactcacttttcctttcagctattgatcatttctctgctcccctctgccgcaaatctctttgaagaagttgtggatactttatttttccccttttttcatttcttccaattctctcttgaacctactgcaatcagttactgtcttcagaatttccacaccaacaaaacacctttgtgtggatcatcgatgactgcatttccgaatataatgatcgggtttttattcttattttctttcctcgtcagcataattttctgtgataatgccctctttatttaaacagcatttttatttgtttcctgagacctctgatttttctcccgtctcattagcctgtccttgtgttctttgtttagtcttcctccttgtcctggtttcagatatggaaataatttagggctgaacatccaagtgtttcctgtctatattcaggtcatcagtgaatttatctctttccgtctgtatactaacgccttctagatttatatcaccacagtctccctcctctaaaatgcagctgtccatctctatctccacatggacgtctggcaggttaccttaacgttgtaatgctcaaagacaaattccttctttctccctccaataattctccccttcccctcttttattaatctcagtagatgccagctttttgtttcgaggtgttttgaactaaaggagtttgagttttttaggtggcagcagacatctggttattttttttttcagcagacatttagaaatattaattgagcatctactgaaatacgatcacaaatagaaatatgtaaaacaatgtggaagcattatccacttaagcaatattaactagttaagattctctaacatacatgggtctttgaattttatttggaataggaaggacatgtgttaaatggtatcagtaacagagctgaataaagacatgaagagctccaaataagctaaagattgggagattatttatttcacctagtaaatagtcgctgagaacctgctacatggcagcactctgctgtgcaatatacgttcaattggtaacaagactgaaatgcttcttaccctcaggaatttatagtctccaaactaaactcccctaaatacgtcccttatatcatgtaatgaggaccaaattacttaagcaaatgagcatttttaaaaagagaaccactaaaatatataaacacctaatattaaaattttatttcaacccaaatcatatacatgcattttacttcatatcattaggtgtaggatcacacttatatataccaaatatatatataaatatacgaatatataaatgccaaataaatatatatataaaatatatatatttgatatataggtatgatcttatgtctaaatatatacaccaaatataccaaatgtacatatttacctacaaacatatacattctacatctctctatatataacaataaaccaaaaaaatagaaaaaatatatatatattttgtatataaatatatattttgtatatatatacatatatattttgtatatatatacatatatatattttgtatatatatatattagatgtatttggtatatatatatatgtggtataggtgggtacatattggtgatataagctaaatatatatccaatatgtatatataatagatatatatatcccaaacatatacatgtaccaaacatatatattccaaatttagcacctggaagcagagagcagcccttaactgagattcagagaagaaaaagaggaaagaggaagattactggcagaacacaggaatttgcctttgcaagttatttccaggtgactagtagagctggtccccgtggatttcaagtgggaaccagatcacggaaatataaacttggaagtcattaacagctagaagacgttaggtaagaaaataaatctgcatagtggagttctgcaccatttttctttgcaaaacacacccagaaggcattatttcacttgctttttgaaagtgccaaatcattctctctctttattgttttccccagtcttttagaactatcttacgcataattccagggactgacttatgggtagtgcacttatggagttttccaaagctttcaatggagagcattagtgtttttgtgaacattttatttcatggtctttgttcatgggtttctcaaacacttaattaaattacttaattattgttacagacttcaccggtagacattaactggtttaatgtgaaaacagaaatgcttgggtgccctgctgagtggactcttcatcattgatcagtcctttctcagagagaatggagagctactggcctacggtggattgagagcgaagtgtccccgcagaagttacattcagctgcagaagggcctcagcttcctcaccctactcagccggtagaaagccctgacatcaatctcagtttctccatttagaaaacagttggatgacctttctgctggtattccagtatgacatataggggtctcattttccatcctaatcatctcatccatgtattttttttaagtacatatgtacaatccccagaagaaattcataaaaagctattttttcagctcttcatatttctaataatgtttttgaaactcaatactatttcagcttttcaggtcatttgcatcttcaggtcaattatatcttcaagtcaattgttgtgttattgcaatttttaatacaagccagaacataggaaaggacatgcagtcataacccagcccatgctgaagtgaaagttccagaaggagaatgaataaaattagaactgatgaaataggacagcagcagagcaacagaggagggaggatgatgaagtaccttgaaataatgattcagggtttctatcttttgcagaagctgatgggaggccctagacgtctcacctgtcagacagggaagtggtcctgtccctctggttagcactgcttgtattctcattaaagccctgtccattgaggtcttatttgaaaaacgaagtaaaaaaaagtgaagcagacttaaggagcacaaagagctggagtattaaaaacaaattctgtgaactacactaaagggtagagtgctctatttttagtcattagaagagaaagcttttggtgataataactatctttcaggaatacaaaaagctttttttttttttaaagaacccgctacccacttagtcgccattactacaaaggatcaaagaagcggggcaaggctgtagaaacacacaagagtttttctgaccctaatatgggtgatgaagccacagctgaaaacttccaagtgtaatacaaccaactgtaggttttgtattcatctggatgcaaatggctcgcccagatgacgtcttgtcctccccgtgtgttatatgtgcgttctgtgtatcacggatcatttgtcagtggcttgaactgtccacgatgtgaactcacaccgtgaccagaaaaatccattatgagaaaattcttacaactagttcgtgataccaaaattccactgtaaatcctaataacttcttgacgaatgccgtgtatctactggagagtgtcaaagtaaccccccctggaatgtgaacccagtcccacaaccagggtctacaagatgtcggagggtaggtctcaaaactcctttagccacgtcgtgaacattacactcagttccaaccgagcagctaggctcaaacgcagcgcaaatcctgtgtaactcaaggtaccagctactaaataagcacagcaaattgtttctctgttatctgagataaatggggattttcttcaagatgccaaaagcaaggctggaatttgtctgagaatgcagattctgaaaggatgagctgtggtttcaagaggcttctttaaaaagtggacatttgagacgcgccccatgttgcttctgaaatacacgtaggtctcaaaactagaaatatcctggaatggagttcgcaaaatggaaatctctgtgcgatatgcccttgtggagctcacgtaactatgtattttctgagctatcaaattaagaaaataatagaaatggagaacaacaaccataaataatctactttgtttatattattgcgctttcacaagcaaaacaacattactattatgtaattaattttgctaggactttctagaactggatgctgataatgctaattaggaaaaatggtgttgaagaaaagtaatcagatcttggtcattcatgtaccaatgaagttcgatactttgctcgtgatactaaacagcttgcaataagacttaaatttaaccttttcatctttattctctgacttttattgtttttaatgtattctttataaaaggtacacttttataatgtgtaaaacatatatacctttcaggatacatttaatttgaaaagttcggatcgcaaatggcaaaagtcacacatttccccttttatgtttaaaatagcaaaagtataaatatttaaaacgtgttctttcacgacttttccctcaaccaaaatgttatgggcttatgttttaaactcgaatcatttatacaactgtaacaaccttcttaaaagaaaaaaacctgtatgatttgtttcattcatattatagttgaggttttaatagtgaagtatacttccgtcagatttcaaatttaaacatacaggctatattcaacttgaatatatcaacttgattcatactacaaggctatgctgtatatcttaacttttaaaaaacgtgataaatgcttcaagagctaatcgttgattaatcttaccaagatacatcttttagaatggtgttcaataatttaaaatacaaagcaagtttattcaatgtctgtgtgaaacttacatttattttttccaaataatatcacataatatattatgtcaattcttcttcaacagaatttcactgggagtataaacacacacacacacacacacacacacacacacacacacacacatatatatataaagagctactatattagtacttataaagatgaactcccagctacttataagtaatgtaaatattatatttgaatctgttatttgtatatttaagtctgattttactttatggtatgccacatgggttataagaaaactagaaaatcttattatattttaatgggcattattagctcttcatataatcagtagtgatatagataaccctatgtttacacacaatttgacatagcttatatatcagtattcattagccagcctgataatactgttcttaaaactgcaaggttaatattttgttttgagactataattattatcataaaactcatgaaaagcattctggaacatccatgttttattttgtttgcaagaggaggtctagttgtcttacaggaaaatgacaaattgcaatggctcacttaagtgcatatagattgtttaaactattttcagtactagaagaatcattcagtgattgatatttaatggtcatgacagagcatcatatttttaaaaattgttttcacgttctttctgcccgagattggatgcacttatctaggcaagttactcaaagtatgttttgaagagatctgtatatgcaggacaaatctcattccctatgacagttagttttgggaaggcaatgggaacaccttacaaggtcctccatgattcaggcactgttttgttttgttttttttttgtttttttttttttacattcgaaagcatattgcatttacattttagattcttacagcacatatgaaaattcctttcattattatttatgtatacctggacattttcatcagaaattcaacaaaaatgtggtaaaaactgagaaagatacatatgtaaggtcattagctaaacaaactgctaattattatttgctttttaaatgtcctcttttcatacaatttacaatatttggtatttactttcagcaaaataaatttcttcctattatgcacaggtatacacagatcctacaagatacaaaatggacgtgttgtcaggtaacacactttagtgacttgaatcataagtatcaggtatatttcacattattatgtactccaaagtattaaaccctctttttgttttcagaaatggcaacatgtttttcatgagttgagcgaacctcggtccttgaaagagttttcttctaactcccgggtatcaatcctggctattgtagtaattggatgattcccagttagccagtgggaatgaagtgaagggatggcaagaaaattgcctgaaatgtctttaaaaggagccgtctacgttatactctatgacttcctggcgggttccccatgagaccatataatagaatccatttccactaatgcactcaaatagattttaatggtgttaggtgtacaagtcagatatataagtatccagacagaaagctgacctctattcacttttgaaaggagatcaatactgttttgccaagatattacatagcagtgtctcagtgagactcttgtaatgccacaagtaaagaaaaatgataccttagcactctaagctgaaaccccaccgagcttagatctgaaaagatcagctggatatagaaaatagcagtaagatctttgtatttcacagaggagaaatctttttttgttgagatatctaaagcagtgtcattccagtagtatttatgactttgttaagaggtagaagaaaacaagtattcctgaaatattcaagtagttgagttcaagtgactgtaattttcctgacgactaccaaatttttctttccgtaaaaatcagctgacatcatattcaaattagaaaaattagaaactttttttttccgctgaggatagtaatgagatgctgagactattacattgcctgtggacttatgcaccctgtagttcagggctcctccaagaaggaacacagacattcctaactatctgatgcatttggaaagttctaccccattcagagcatactcctgaagaatcagcaatcctcccaagtcctaatggaagcaggatatagtgacttcagactgcagtacaaaatgcattttcacttcacttagaaggcatcacttttcactcggtcaagagatacacagcattgggagaagtagccatatttagttaagtttgcctttgataaaattaaaatctgcatggatattaaatatattttcttcaccaaaacaatttttttctctttcttgcagtctgtatttaaggaatataatatgatagcttgatatgcatagtcaaataagtgtactcaagcaaagcaatatatttaatatatttaatcacctcccatagtcagcatgtgtgtgtgtgtaaaaatcttacatcttctctcttagtaaatttccagtatacaacataacactattacctatagttttcatgctatatattagatttcttgacttattcatcctacataagttcaacttcatactttggactgacatctcctcattcgatgccagcccactccaataaccatcgttcttctcctgtttctttgtattccgtttttgtaagattatagatatgaaataaattctagtttttctttcgtgtttggtttatttctcttgacataatgcccttcagtttcatccatgttttcacaaatgacagtatctccttttgtaaagctgaatcatgttccactcatgcattggtggatgcctaggttctttacataccttggctattgtgaatgatacctcagtgaacatgggagtgcagctatttctatgaggtgctggtttcatttcctttggttttagatacaacagggggattgctgggttatatgatatttctatgtttaattttttgaggaacctccatactcttccattattggctataccaatctatattcacacaaacagtgcacagcagttcatttctttacatctttgtcaacatttatctttcattgttttgataatagccatactaacagatgtgaggtaatatttcatagttttgatttgtatatccctggtgataagtgatgttgagcatcttccagaatagtttgtatttcaaattgttcagaatctgatttgtagtagtcagattcattcttttttatatttgatgattcttagtttatacttgtctatcactaggcagtagaataaaaagagattgttctactcatcaaacccaccaactacaaaatcacatgtatttatttcttctttctatatgttaaacatgatactaggcatgaggaaatatggatgaggaaaacacaattcctatgtttcagtaaattacatggatagggacaaagtatatggatcgcaatagtttaatttgattagtcttttgctggaagaactttattgccgagttgcatttgtaagtttccaaagcctttttcatacttcctccttaaccctcatgttactcttgagaggtttattattagagtggttttatgaataatgctataaacacaataattaactgtttatttaaattccattcaaataaaaattgtcttccggtgaagtaggcagggcaagcttaagagctggtgaattgtagattcacgaaagttaagatgtttgatcaaggtcaccaggtatgtttgtaccagagacggcactaggatcttggttttcccttggcttctagactttccttctgtgttccttatggccgttgttgatctttagatggaattctaagtcacaaagtatggaccaagatgatttttcagaaactttataaatattccaaataagaaaattatttagccagtcgtggtggctcacacctgtaatcccagctctttgggaagccaaggcaggtggatcaatcgagtttaggaattcgagaggagagcagcctggccaacatggtgaaaccctgtctctatttaaatacagaaattagcctggcatggtggcatgtgcctttaatctcagctattcagggggctgaggcaggagacttgcttgaacccaggaggcagaggttatagtgcgccgagatcatgcctctgcactccagcatgagtgacagagcaagactccatctcaaaaaacaaaaaaaattattcaaatgagaagtagtagctgatagttttgcatttaatatagtttgtcatattttccttgagataatacatggtaccatgttattctggtgcaatagattttgagaagaaggaatttcacattgctttctgtgatatttggaaaaatttttccaacttttccaaaaatgatacattccctttatatattattactaagaaacatcaaggaacaaaagtatatgaaatataaatatatatatatatatgttatatgtatgtatacgtctagctttgtgaagcaaaaatacaaaaactccaaaccacagattaagaggtggtattttacataaaaaatatttcatttagaaaaagcctcaccacaggaataatttctttaaaatatttaatgatctgtaagtaagcacttaaacttggtgagaatgactgattattttgtaggtaaaatgtagacaaaaaatttaaagtgaggtgacattagctatcaacaactgttaaaatcaataaaaagtgaggtcgaatatagatatgtgagccctgcatagggagtcctttcccatattttatactactttaatgagataaaattttatttatgaaagtaaaaggcagcaatagttcaagctctcaaagggaaataataatttgtactttgaaaatcgtaagtgcatattaggaattctttaggtaatttaaaactgggtagcttttactgaaatacataaatcaaattactttcatctggaagtacaaataaatggaaatttagcttttgaacaaaataggaaaaggattcaagtttttattgaccttaccatcccaaagttctatgctatcttagaaaggatgcaataattcttaaaaataagtttgttgtgaagattttttttttgtaggtgggggtggggactaaattacttacaatgcgcttgaagaaaatgagagtccatttctggaagaaaggaagcagcaaatgcctgagacttataatgatgcttttaatgcaacagagaattatagggcaggaagggagggagagaaagagaatgagcaggctcaagcgcattggcacgtgagagagaaggaaatagattagaaaacccttatttcttattaggcttcatttatttatctactttgttaatttagtcctgaagataacttgcacaaaatgcaaaatctaaaacatgacaatgtgtgccatctagtctcccccacccctgcactttctctagctgtgtagtctttttttcacctgcctttctccaggccatcattgtctttagtttcttgttcatcattcagagcttctttgtgcagaaaccaaccacattaaaacaaaattctagctctctctcttttttttcttcaccagtgaaaacataatataaacttcagttgttttccttttttctcatacctacatatcttcaaagtttttcatatcaatatataatgaacgttctcatttttcctgtcagtgtataatgaacattctcattttttaatacaatgtcatagagttcaaagatacgtattttcattcatttacattttggtactttttagggagtattatatctttaaaaatttggtcttgaatatttcatgttaatttccttatattttaagtttctattgctttaaaaagagtattttcttttataaaattggttgttttttaatagaaaaactagtcttttatgataatttacttcctgtcacctattgaattctttcttagtttaaaatagattttttaaaaattgattttatttggttttccagtttaaaataatatcaaaattcaatcgtactatatgtttatctcctccttttcatgttttataaattttttctttcttttttcaaattcccttagctagtacttaatgtaaaatattaattgacagcgggaatattagttattcttttctagttcctgtcttcaggagtgatgtttctaagatttcattcctgcttaagaatcagcctggttttagtggtgaactagatgtgttttatcatgttaagttgactccaatttatgtatatttaggtgaattttaccaatagtgataattgattgttaatataagaaatcgttatatatgttttttaaaattttgatagatttgtatggtttagcatggtggctcacacctgtaatcccaacattttgggaggctgagacaggagaatcacttaagcccaggagtttgagaccagcctgggctacataggtagaccctgtctgtacaaaaataatgtaaaatatatgctgggcatggtggcatgtgcctgtcataccaggtactttgaggaagtgggaggatctcctgatccagggaggtagaggctgcagggagctgtgattgtgccactgccctccagcctggggtacagagcaagacccagtctcaaaacaaataataaaataaaataagtttgatagattttataaactttactattgtttgccactgttttatacttcttctgtatcaatactttagtcatcctatttatttttagataatttaataaaaagctattaaatattcttggacttaatgtgaagagattcctggggtggcggtaagatctgaaagggtcagatagtctacctttgtatgcttttattgacaatctgacagtttctgacagagactgattgcttcctgcaaacatggctccactgtatgtgattctcttggttacccagcctcttcggaatcacagttctgtaaattccttcccactcacaccagtgctttccccgttgtagaaatatatatagttcctactgcttgtggatggatggatggatgtatggatggatggatggatggatagatagatagataggtagacagacagacagattgataggtttgtaactgaatcttgtcataggtagatacatatatagaaaggggtgtgtgtgtatatatatatatatagtgtgtgtatatatatagtgtatgtgtatatatatagtgtgtgtgtatatatgtatatatgtatgtatatgtgtgtgtgtatatatatgtgtgtatatatgtgtgtgtatatatacgtgtgtgtgtgtatatatatatatatatggagagagagagagagaagggcagggtcagagatgcttctttgaggccctattttcatcctgccattaccaaggtagctatgttatgtatttggaacctgttaatactgttactcctcatcaaatttttctcctgactcccaaatatctcactgtataccctagttttttttcctaatgattattttctcatgattagaaaaaaatagtttttctcggggcagagagggaagaaggtaggacttatttttcctatttttctttgtgatattcaggaataaagaggagaaaatgtgtcctcatcaacccaggcttctataccaggagacttggattttgttgaaatggaattatactaagtttcattttttaacctattggatctcattgttaaagtctagatatgatttttttgcttaatcttctagagaattaatttcaatctatatacacacaaaatttggttgtttcaaattcattagttgctaagagatgtttgaaaatggcaaggaaaaaggcgagacactgatttctttcctgccacacttgtttatttagacctcagtttttagttaattctcacaagactacaaaattaaaatcatcttgaatagtcctctaattatcagatatatttagaatttaaatacttttcttaaatgctgaataggccaggaattcgggagacctgtgttaatccatattctgctactcatttctataagaatatagtaaattcctttaacatctgtgcctaaaatttatctgtcaattaaaagtaggtaagtgtaaacatagataatggatgttgaagtattatgaatactttaaaaaccttctattaataactgaaaaattctgtttttcagatattaatcttgatgtcccttgtatacatttatgaaaaagtcccatccttgtgttggccttccaaattcagtgatcagtcacttgatgtcatgcctgttttctcttgaagaagacatttcctcagccacatgaccttctttgtgccctttctgggtgttgagggagatggatgaagagctggcattgtcttgaagtgtaaggattcttggcagacagccttctgttctctagatgagcagtccccattgggtggcgcctgctcagggggattcctcgctgaagtgtgaagtcagcctggctcaccaggcaggtcatctcacagctctgtgagtctcccgactaagagtccctgcccccaacccagctctaacagcagcttctctgtcagctcccttactattggttggctttggaatctgccctggcccctgtgctctttggaccactggtaagatttaagcagtcatcacaggacctgatacacatttaacgaagacgatttacaagacaattttagctattatgtgaagaatagactctagaggaaccaggacagagccaaggaccctttaggaggcaattcccgtaatccaagcaaagtccactttggtttggtccagaggggtagtgctagagataggaggacgggctcgttttgaagggggagataacagaatttgctgacaagttggatatgtgtgagagaaagagaggggctgagggtgataccttggtgtttgagttgaacgcctagaagggaacagttgccaaaattaagatgaatctggaagagaaatgattttgaagggaaaaatcaggagatcatttttgttcacgttaaattttggatgtcagtgaggcatccgcagagaagttcagggtggaccgttggatatatatacgtgcaattaaaaggggaagtctgatctggagatacagatttgaggattatcaatttatatgtggtatttaagctgtgaaaccatatgagattgtcaagggaatgggtaaatagaaaacagagatgaataaaggtatctgttttacatgtttatattatattcaattttaatattgctctttgatgaagcattgctttgtaaatttctgaattactttgtgtaaaccaaacagaaatcatgtcaaattagctttaagtaacccttaataattttgtcagagccaaacacaggttaggttatgaattcaaattcataaaaacactcagacattcttcatatttcttcgttttctttttctgcgaaataatagaataactaaagcatagttagtttatagttacgttaatcttactagtttttggatctgaactataagtgatgagaggactggagtgtttttggataattatctggacttaaataacagaccctgaataacataaaaaaatgcttgaaatgttaaaatgatatgaaattattgccatctgtgagcataaagggaaatacagtctaattttacaaaaacagcagcagaattctctagacaccttccaaaaagtctgctatggatcatagtcaaattatacaattattctaaaggtatacagatttttttcttcggttttaagaatttggagcaaaagaaaaatctaatgttactgtttataatgttgagtctattttaatcccaaatttttcctaacattatttttcctctattatttcagcaaaatttaagtggcataatttctacaagtggaaatttgtattctcgagtaaatttgaactgcctagcttcttttaaatgaaattaaagacaagtatgtctttctggggaaagggcctgtgtttttggatgagtggtgtgaatttgaatctcagctgtgttattcaataaccctatgaacttgggaaagttccgacttctctttgggccttctctatctgttatgttcaattgggcaaaattattaaagtatttctgaaaagttaagtaagatgaagcatatgaaagcgcttatgtattttgacttagaatttccatttcctttttggggagattttatttttgtctttcagttgatgcacattttttaatttcttacacatattaatttaaattcttgaccccctgaccccaaactttgcaagtgtgagaaaggtctagatttctttttcttaaagagaaaaaagatggcatctgtttgtttaggatgagtatatttctgctgactctcagggaggtggcggaatgacagaggaggcgtcaacacggtggacgtggagcttggtgttggtgtgcagaacacaaggtattcttttttttttctttttgagacagagtcgcgttctgtcacccagactggagtgcaatggcatgatcttggctcactgcaacctctgtctcccgggttcaggtgatcctcctgcctcagtctcccgagtagctgggattacaggcacctgccaccatgcttggctaatttttgtagttttagtggagacggggttttaccatgttggccaggctggttttgaactcctgacctcaagtgatccaccctcctcggcctccccacaagcccaaattttatctccacctccacttttggcttctgcccatcttcaaaagataggaaaattaaaaggacagaagaaagcatgcagattagaatgacaccctcctagaatgatctccagcccaagcttctcagaacttacctgtccgtggagttgcctcaggggccaggtttggggtttggggaggaggccgtgaggcagtggcgagcagctggagctctgggtcctgacctctgttttgttaagagacgttccacttttttatattgttatgtgagaactttatgcattatcatatggtgaaaccccgtctctactaaaaataaaaaattaactaggcgtggtggcagccgcctgtagtcccagctacccgggaggctgaggcaggaaaatcactggaacccgggaggcggagatggcagtgagccggtatcgcgccactgcactccagcctgggcaagagagggagagtctgtctcaaaaacaaaacaaaacaaaacaaaacaaaacaaaacaaaacaaaaacacaaagctgactaataaaaagataaaagctatggcaagacaccacaccaccggatgggtctttaagcatcccaggtttccaaaaaccaacttaaactacactctcctgctccgcattccttctgtacttgagtaattggctaataaatctgaaactaatttggtctaaagtgttaatggttgataatgatttaatgtgtttccccacccggggaacacatttgcattttaatagaggtcctagtggcaattttcttaactcaaatgaatgactttaatggtggggatttgaggtgcagcggggaccgattctggcagaagacctttcccagtatccctaagatcacaccttgtagtcaggcagcctaatatcattaatattactgccagtaattcccgtggatttgcctttatagaaaattttcctttttctaattgcgagacttgtatgtcaatcaagcaccctttttgaaaattgtcttcttccatccatcggcatggatgtctactaaaatatatccagattagacctctctgaaatagaaactttagatagtacagtcatgtatgtgcctcagcacgaaaccaacaggcagtggtcccaaaagaaagaaggaggaaacaaaacacctttaatatcacaagtgaaaaaagagagagagaaaaaaacacaccgtcactattattatctatttgtgaaatgtttactagttgcccaattagaggaaaaagatgctgcaaatctcatcaaaaataaacaaatcctagatcttaaatatcttcagtattctaaagccccttctttctgttctcttctatttcacttactatctttgctctgataaagggataaggaaaataagggaaattttcctgcaagcaattagccatttctgctttgacatgggaaaaaaaattgtgagaagggttcagagtaagagtaggtagtcctgcatccttctggttttatttttgacctacagattattagacagttctgtgtgtgccatgtacaaatcaaagggttttccgttctggaaatgcgtggttggaagtgaccatcattaaattacatctcccacactgaagtgtactctcacctacatgtatcctcagccaattttgaatgatgctatttgcactgaggatcatgagtagaggtcaagagctaatggattcgcagacatttgagcctgaagaaatgaaatagaagaggttcactggtctatgccatccagcttcaaccacggtcagtcccattgattgacttccaggggcattgcctaatttcttcttcatggcagtgaacatgcattttatgggatttctcctgagaaaatctcttctagattttctctgtagactcttaggaagccacatatttcaaatcactgacttgagtttaaaactgtaccgcaaatgagatgtgcacagtagccagccagctcagtccctttcctgtagtaggcacttaatccagctggtattatttgtgccatcatcaccatcttattaacaaagatcattattatgatagaagaaaactacttggttcgggaccttttttaaggctcctgtgaggaaaattaaaaacaaaaaacaaaagcaaacaaaaactacataaacacaccaaactgaaggaaattctggaattatattgaaattgtttttagactcaaagactttaatggattttttttttaaatttacctacagtaaagaagtattcctggcttttccgactgcaaaaataattctcttacagactatatttctaatttagtaccaatatatttttttttcaaatttctctgtcctttgttgaaaaccttccatagcactttttttttcaggacagatgtcccaaaaatactttctctgaaaataaattttgctttacaaaaataaaaggtactttcacacctttgtttgaaaatgcagctattactaaacaatttgtcttctgagaatcactggtacgaaaactatgcaatttaacattaatttcctggaaactttggctatcaataaatagtcaaaacaaaggtttaatttgcccttcagtttattggataaatagaaaatgacctaaacaagtgctcttttataagtgtgatgattctcaccacctcatttcatagcatgattaacattttttacttcaaatttgcctttccaagtatgagtaataaaaggatcatggttttttttttttgtgagaaaattgttgagaatttcatccattttaccaaacttctcttataataatttgctatttacataagactgttttctgaaatatcatgtcatgattttgcctaattttattttctttagttgctaactagaaaaggcctgggcacatctgtccgtcacctcacatgtcactcaagtacacatccaagagcaccatcatttgtctcaggatagggcatggtccttttatgtttggactcaggccattttctagttatgtaagtcttttttctcattgttcttttatttttatttattattattattatttttgagacagagtcttactctgtctcccaggctagagcgcagtggtgcgatcttggctcatgtcatcctccacctcccgggttcaagcattttacctgcctcagactcccaagtagctgggattacaggcatgtggccccatgctgggctaattttttgtatttttagtagagacggggtttcaccttgttagccagggtggtctccatctcctgagcttgtgatccacccatctgagtctcccaaagtgctgggatcacaagcgtgagccaccgcacccagaagccatttttctttttaaataaccacccccaccatcttctcctggcacacttactcaatgtaatttgagagagacagagatacatatatatatatatataatattccattatatatcaatatataaagtttatattgtattaaatatatttataaatttatatatttaataatatatttttatttacttcatatgtttatttaaatatataattgaagtattaatgtactttagaatatgtttatatgcgtttaaatgtatacacatatacattatatatttaacatgcaaatgtatataaaatgtgtataaatatatgtatttcatagtaccttgaataagagcacactgaagatacgtatatatattttatcttgtgttggtactgggcagaggaaagcatgcagacaggaattaatccccccttagaataacctccaggcgaaggttatcagaacttgcttttccttgggcgatattttgtgttcttgccccagattttccaaatcactagttatcaagtcagcttagtggcctatttgaactatcaagtgatatttttatttaattacccagtttttatcaaaatttctaaatcgacctgatattttcttccaagaccctgttttttcttatggtttctagtttttcaatccttgggccatttcagatgtgtttactttaaacgttcattgagacttttccgttgatttcatgtgtattttactctgcgggacgactggacactgtgctcttttcctctcctgcctctttcccctgtgacttctccctgggagccatagggacgcactgatggagctcacctgcacccagccttcctgctatgcttcccacaggtgccccaggctgtggaaaaccttcagagtaggttaaacattcatctttgctgaagacccccagtagtcttgggctcctggccagttttatatttgtttcttgcctttggacagcttctgcaaattgaatttcccatccacggtgagcaacgacagaggctccagcctcgaggtctctgccctctttgtaccctcagcctgaggaaggtggcacatgaggctccccctgttccttacgtcctatggacagagtccctctatttcctgtgttgaggccagggcagccccaagtaaaaagagtctttatgttcgtcccttggctccaaattgctgcacacaatgggacatacagcctaaactcccccaatccaacacagaggcctcaggtatcaacctccatagttcagcacctccttctacctgcagttagccaaggagtcatttttaactctactccccacaccagtctacaagagtagcctggttccttctaccatcgaggaattcctctctctcgattgtgagctgagctatgcatcaaacaccatattgctatatttcgttcagaatttccatgtgattagagtaagacattttttccaacccagtctaccatattgggaagcatattactttgctagggctcccataacaaagtaccatagactgggaagcttcagcaatagacatttattttgtcaaggttcaggaggttggaagcccaagatcgaggtatcagcaggattgctcttttctgaggcctctttctttggcttgtgaatgaccaccttcctgtatttgctcacattgtcactctctgtgtgttttgaattctaatttccctttcttataacaacaccagtcatgtcggattagggaccaccctaatgacctcattttaatttaaacatctattacaaaatcttctctccaaatatagtcccatgctgggggttaggactttatatatgaatctttagggggtcacaattccaccgccacagttgggaaatctttctcttaaaaaaaaaaatgaatctggttaggatggtgtctataatgatgacagaaaacactagaaatttaaccattcaatgaactctttctgattggctacctagtttaagtgactcaaagatacaatattacctggcaatcaccttcctttaatttaccttcatttttaagagaattactacagattgagttattgtgacttatcaggatggtaaccattactttttcattgttcctatatttgtttctttagtgaaactattagcagttttactttttaccagatacatattcagttttaggcactgaacagaataatgaacaagacagatgttgtctaaatgttcacggagcttacattccacctagggagagagaaaatgcatgtctatgtaaatgacaatgatttatattctgaagggaatcaagagtcacactgaaggccagatgcagtggctcatgcctgtaatctcagcactttagaaggcccaggtaggtggattgtttgtggagattcagaccagcctggtcgacatagcaaaactccatctctacaaaaaaataaaaaaaaatacaaaaaattagccagtgtattggcagatgcctgttctcccagctactgcagaggctgaggtagtaggatcacttgagccaaggagtttgaggctgcagtgagctatgttcatgtcactgcactagcctgggtgacagagtgagatgtgtcttaaaaacaataatcacacggaaacttctttcccctctttttttttttttttttttttttttttttttttttttttttttgaaacaaagtcttgctcttgtccccaggctggagtgcaatggtgcgatcttggttcactgcaacctctccctcccgagttcaagcgattcttctgcttcagcctcccgagtagctgggattacaggcgcctgccacgacgcccggctaatttttgtatttttagtagagatggggtttgaccatgttgggcaggctggtctggaactcctgacctcaggtgatccgcccgcctcggcctcccaaagtgctgggattacaggagtgagccatcatggctggctctttcccctctcttgttgctcgtttgcagtaaaaacctgggaatttagttagcatctgttctacaagcggcctctccatttaactgttcacggactcctacgctgatttcccttcctaaatcctctaaaaattcaggcgtttctgttaatctgaccttccaccatcagcattcctgcactatgtgatcatcttgtctttgtttcccagcacgattaaaaacatgcttttggaaatctagattttctttgaataatgtcccagctctcctttgtgatcttgaagaaattaatttaacttctccaagcttcaatttcctcatgtttaaagacctaatattccttacctcctaggaccgttgtaagaatgaaaatgagataatgtatagaaagcctttaacaacagtgtctagagtgcaataactattcaataagaggaagttattattttattattttcacccagatcactgtaacagctttctggctgtatttagtatctgcttcattttccacacagctgccagggtgatctttcctaatctcagatctgatcaccttaagtccttaagttagatctgtcaatgacattgtccaaacttcaagagaaaggtccttcatgactttgtccctgtcactctaaccccaacctctgccaagcttcagatgagcaaattactcatagtttcatgaatcagaagcttttcgccttgcctttctcatttcactgaactgcccttgctacttgtaagaagtttcccccattctctcaatcgggtcaactgtgtttatctgacacaagtcaagcactgtctttctcaaatgcgtcttctgttgcctctgagtgagagcccttctctctgaccctctgcctccccggccacatctctgtcttttgttttttggactttcatgccattattaacttcagccacattgatgactagaaattgtttatctttatttcttcactcctaaaatactgtttatactaactagacacttcctaaatagttgaactaatttaaacatggcataagttgacttaaatgatgccgagttaaatatatttgtttatgaaatatgttgatttgtgaataaaagtatttaatgctatatttactttccccttttgtattatagagacatttgtgaattactgagctcattggtcatatcatctgttatgctatagcaatttcattatacactttttgtctgcagataacgtagtctaattcagtatggagtataataatttgaagggttatgtggaaaagtattttatttatttcttatttcatggggtacatgtaaggtaatggacagggaattaaaagagaaattttaggtcagatatgttgtgggactttcaaacaattagcaattgccagatattagaaatattttggaaaaaatatattgaaaaaatatatatgtacagtatataaatacataaaattttaatataaaatatgtaatatataggacatgaaaatatatagtttttatatattatatgttaaaattttatgtatcatgtattgtgtatatataaaaaattacatattttaaatacattactgtttatttttaaaatattgaaaaaaattacagttcataaaggtcatcctaagcatttatccagaggtttgttgaagagatttctttatcaaataagcagcaccaacaatagacctagttaaactatttttccaatagtcaaatgaaagaatctgtatattttaaagtgcccccaggacactcagatgcagctggctcatagaataatctttctcccagaactagacactctgtaagatagaatgttatcaattattcagtcatattttaaaatattagttagattatatttgtaatgtccaaatggtttcagacgttaaagagacactcagaaaagagtgatattcatatgacacgagatacaagggccggaaagaagagcttcgttcatgccgcagtatcagaatataagatgagtcaaaaatatctgttcaataagtactcctgcctttcagtcaaaaaagaaatatgccgtagtagaatctaggggtaaagagataaaggctgtgcgcgtttccttttcttggagaggataattgcaattgtacacagcaggaagactatgtgagcacacttttgaatgacaggcgactggggattagggttttgtgtctttggatgactatgcatgttcttgatagacgctgggttgtcttacatcatggtttccagaaagtatgttcttagaatggagtctctagaacatagaactatgtgttatttttaatacccattgtattactcaattttcacactgctataaaaaaaataccagagactgggaaatttttaaaagaaggaggtctaattgactcacagttcttcatgggtgggaaggcctcaggaaacttacaattatggtgaaggggaaggaggaaccttcttcacaaggtggcaggagagacagagggtgaaggaggaactgtcaaacacttataaaaccatcatatctgatgagaactcacccactagcatgagaacagcatgggaaaaataactaccatgatccaaaattacaggacgcttcctcaacacgtgtagggattacaattggaagttagatttggacacagagccaaaccatactacccatggagtttactaagactttattaaaacaaaattaagcagttttctttaccatagggtttttggagccttctctagggtgttttgccccatcagcatagagatgcagtaggaagcacttccaagctcactcaggctggttaggacaactgccactccctttctcctgcctcgacaactcacacatatccagaacatttgaaaggacaggcattccattaagcaagcacacaagcaaacaaacaaaatacttttggaaaaattggttttctttaaatgaccagtagaaggtaagaatggttaaaagaagaaatgtacagaattagaaaatacagagttgatcgatgtggttatgtttggttgaaaatgttctgtaatcaaaagcagtcaatttctgtataatggcactgaaacatcagattaggaagggagaaaatagtactacaaaaattcaaatttctgaaattgaatttcagtcaagcaaatatttattgaaatcctagtctctgccagacaccacataaacaatagataagtaaataaacaactgagattcttactgattgcaataagtactgtaatcaagtcccagacaactgatttgtgagtacagtaagacactcaatgctgaataaaatataaaataagtaaaagtctctgttttccaagtatacttggggatagcacagggattacaaatgcaaatgacttaaatgacaatgtaaggtgctaccagcgtattaaatttgacttacgtgttaatagagactggggcttgagtatttagctagatcacgggtccccacctgccttggatgaaggcctgtatcagacgttggcctgttaggaaccagtctgcgtagctggaggtgagcagccagggaaccagcattactgcctgagatccgcctcgtctcacatcggcatcggcattagattctcatagcatgaaacctactgtgaactgcatgtgtgagggatctaggttgtgtgctacttgtgagaatctaatgcctgatgatctgaggtggaacagtttcatcccaaaaccgtcccccaaccctgctgtccatggaaaaattgtctgccagagaactggtccctggtgccaaaaatgctggggactgttgagcttgatgatcgggtctcttcgtatcccaatgcttttctgtatctgtactctggattttagtaaaatcactttaagattttttttaaagaaaatcttttaattcaaggtcgcaggcaatgctaagtcaactactatttgtcttctagattacttttcttgaaatatttagaaatccccagtttgggaaaaattgaaatatttccttaacaccaaagtgttttcattacttttcataattatactgtatatctaattccttgcaaaattgataaaaactgtatcaattttataactttcatgaagtatacatgttttaaataattacaaattatccatacattggtgattgcaagataggctattcatgcatgttctaagtacgaaattacaggtgacagaaatgatgttgagtccatcgctatttcttctgtcagtagagaaagggagatctttgcagaaaggtccgtggagcgacgtatatttgaaaaactttctgagaagattctgattatctacactccctactaatttttccacacacttccaccatcattgccatggttgagaaccgttggtttacactgtatgagctatagcatcatccactgaattttgtaaagaaaatttgaatctccttaaatggagatccatacttttttctgccagatattgcatctaattaaatattatataatatgccacattactcaaatgcaaattatgtatggtataaaataatttgcttaaccctaaactgtgaacattataaataaaaatatcgccagattcttttcagcattttaaataatcattcttttttgagagtacctacttttaaaagtatattttgagaccctaagggtaattttgtcattttagaagtctacagtctatgatgaaaattcataattaactttttagagacttttaaataattttctttaataatgttatccattaaagaactaagacaaagagaagatatgatgaatcccgctattattatttattttgctacctaacattttcccgcaaaaggatgctctttctttccttccacagaatagacaagaaactctacacggtagaatttttgtacttagcaatagaaatacggttgtattagtggttattaaaaatgtttcttggaaacgtttatttgtgattctcagtgtgttctggactggtaatgaggttcattttgtaaagggcagtgtgttctcctacggaacctttcagatgatttataattcatgaatgtctttttattttttaagctggtaaatatttttattttccctgttattaaaaacagcagcaacattttgactgaaggggactatttagaatgttccagagtgaacttcaagatgtcatcttactcaaggttgttttcaaaactgttgttcaaaagtcaattcttggaattgctacttcggagagcaggagggtcagtttagcaaagattcctaatccagtcagaggcccatggccatgcaggtctcagaagcaaggcaacctgttgattttttatttttatttttattttaagttattgggtacatgcacaggtttgttccaaaggtaaacatgtaccatagtggtttgctgcacctgtcaacccatcacctaggtattaagcccagcattcattagctatttttcctagtgctctaccttcgcccacctcatccctgacaggctccagtatgtgttgttccctttcctgtgtccatgtgttctcattgttcagctcccacttataagtgagaagatgcggtgtttggttttctgttcctgagttagtttgctgaggataatggcttccagctccatccatgcccctgcaaaggacatgatctcattcctttttatggctgcatagtattccacagtgtacgtgtgccacatgttctttatccagtctatcattgatgcatctgttgattcttaatggagttgcatgggattcttcatccagagtaaatatgagattatgcatcttcattaaatcttccacccaaggttttctaaaacttgtttgaagaaagtaacacttaaaagtgtttagaaaaagaggaatgttatgatttgtcaccactctacttttttttttaaggagaaaggtttgacagaggagatgtgtggacctagcatacttcaaactcctgtatactgtcaacagctgtggaacagaacctgagagtcttgtgatcaacagctattctcaaatgagaatcagtactgtattgctccctcccatgcccaccattgatgcttcccagtccctctgggaggcggcctgggtgttctgtgctggggtcggggaggaggagtactgtgcatggcccctccccatcagactctccagctgtggttcaggcacaggacaaagtaagggaacgcatcctgggtgctctgttaggtgcctggcaagataaacaaaggagtagtaagttcttaagcagagttaaaaaaaaaaaaagcatcaaaggaaggatggctcaaaagcagccttcgaagttgacttatcattggtatttgccaggtggaagcagacctgagaagtgatgagagagctctgagcaaagaacagtcgggaactaggggcacacagcggacggactctcccctagctgtgggggagcccacagctttgtgtaaaaaacgaatttttgaaggagttgcaacattcacctttcatcctaactctacccttaatttcaataaaactcatctatcagatgttttatgtactcatactttgttcactagtttgcctcccgttcaccgataaaccccagctcctaaactcacttattattagaagtatgtacatgcaggagaccgaaggttacttgataccttccacagtgttctctgctcctctgaaatcttctggttttgttctccatgtaacaggagcactgtaggtctattgttcttcatcctttcttcctattcttgctgttacctttttttcatgctctaatccgttctacagaaatatcctttccctttatttgttaaccatttttattgcagcgtaagttgcatataataaaatgtgctgactttatggatataattttgtgagtttctgaatatcatatacaggtagaatatagtatattctctttatgtgtccagttactttcattttttgtgatagattgagtcagttgtttctgttaatgatacccaattatttcactaattgagaccttaagcaaatcacacttaagtttttcatcctttgaaatatcttgtctctctattagacaccttttcattgtaacatgcatagttttatagttttaaatttaaagaatatgcaggttgtttccaagcaatgaggtgtcacaaagtaaacctacctgtttataagtataaaacttgtaaaagcaaagtatagcaaatgatcaggttgataacaaataatatttttataatatgtattataaataatagattaatgataaaataatcctttaaaacattcacgttggtttataatactcacaaaatttgagtttcacctttcctgctagaaaacaagaggttctttctttgattcctttgcttggttttattatttttctaagatttcaagattttgtttcataaacatgaactgaataggtcttgaaaggtcagttaaaaataaaaattaaacaaaaagttcaccacttattagaaaaatgactctgtggtgagctccttcatctcattaggaaaaggactcagtggtttctccttcatggctctttgtgaagctttctaagattagcgagatgaagaaattgaagccatgtattataatgagagagaattacagaatccaagcctgtcttattctaatcctagcttgtgtatccagatagggattttaatcttccaaaggattccattatatctgaaaaactttgtctcttgttcttgctcgcagtattgtcaatctcacttgtactctctgcatcggcaagacctgttcattctttaggtgagttcaagcaccatatcctttcctgacaaactaaccatgaaacactgctttccatgaatcacagtagaaattaacacctcataaattgtctgggagatttttaaaaatcatatgtacggatgatgacattgtttaaaatgttctaaatttttatctggcttgtggtttcatatctcaacaaataaatgccaagagctctgatgtttatattcttattggttaaattagaaagaaaggatccacacagaagagttaataagacagaaaagaacataagctgagtgttcgatgtacagctttgactttctcattagcacagatggatttggggaaaactttatagaatatgacattgaacctgggtcttgacaatagaacaggcattaaaagatgatagagtgatcagtacaaggtgtgagttgtgggtactctcagatgagtaaggtttggaaacaattttcttatgcagtattaagagaagtaaagcactctgctagaaacagagaggtactgttggtatagaaggaggagtgtaattgcgaataaactctttgaaagttatcctttaagcaaaggaaaacatttgagtattaactttacatacttagcaggctttgagaggtccagagtgaaacacggaattaattgttccaaatctggcatcatccaagtaaatgattgagtaatgagaaagcgaagacctcaaactctagcaggacatctacgtcaaagcacattttttcccaaaactgtggacaagctttaagttaatgaaaggcatagatagtggagacacaaagcatgaccatggcaaggcagtgataatcctgacgtgttcgttcgacggtgaaattggtgtgtgtgtgtgtgtgtgtgtgtgtgtgtgtgtgtgttgggagggtatgcacatgtttaagagttggattgccaaaatgtattgaagtaaccctattggttaggattttcctggttgaaagctaaatcagtctcaggttataagaagcaagaattgtttttatatggtggaatttttttttttaaggggcagagagtttagtaggtaagaaggaagggagaaggtggaaggaaaatgctcccccgtacagagggaggagggcttcttccttctgtcttcctgtcttctcccttccttcttgcctattaaacttcctgctccttagaaccaaaaaaaaaaaaatttctatcatttccattgtataaaaacagttatctttaaatctgtccctgtctcaaaaataaacttccctgtaggtggacttctttaggcctaacacacacctgagctggttttctatcccaactgccttatgagaacataagcatgaaagtttgcgaatcacaccaagcctgttttatgcagaacagagctttggaggtcctcagaaacctttgccttctttctctgatgcattcaccagtttatctgttttgggacatcatctttaagttccatgagccgttgttcatcaaaaactcatttgaaacgagcctttatacagcattcgacacagctcttcatgttgactaaaatgtttaatactgatgaagaaccagggcttacttaattacattaatacagatgaaggtgcagaaagttgtggcatataatattatgttcaattccaaaaaaaaaaaaaaaacccagtattcaaagcaaaagtgttcacagatttgggaattcatttatatttgacatgtttgggaacttcacttaatattttgatgaacccttccaattatataatcttatttctctatggacatattaagtgttcgatgtaagatctagatggtaatgaatacttacatttaagcatcactatttgtcttgacaggaccaatgttttaaacgtggttggcagtctgtgttattcttaaactaaaaatggtcctttacatattatgtaagatattacaaatatcaagcagtttactaattttgaaattatggcttagtgtttatggcttacagaatgagaatgtgtgtgtattttatcacagtttgtaatgccaaatgagtaatgctttcctttttttactttgagttattaactaatccacatatttcagaactctcatgtccagtaattaaaactgtccagggaaatcgtgtaaccagcaactaatatcagtccctgcttaattgcctttggccttataatgttgaacttattgactgaactctagtcaatagtcacttgaatactacaattgttttgctatcgtcgacattccccaattgagtaaacaatacaggacatagaattccacctaaagccaaaggaatatgttatacctaatagctgccaaattttttacgtattgaacttgcctctgtaagcaaatatgagcatgcccaaatacactaatttgctagcatgtaaagtagccacttaaaatcaagcagaaatgaaagcatcataaatatttctcagaatgcaacttttggtgagaagggcaatgataactaagtccaggtggtcctcttgttttcatcttgtcttgctatatgttctaagggcctttacagcaaggttctgttctagaatcaaaaataagtagaatgattttttctgatttttttatttttattattatttttttgagactgagtctcattctgttgcccaggctgtagtgcagtggcgcgatctcggctcactgcaacctccccctcctgggttcaagcaattctcctgcgtcagcctcctgagtagctgggattacaggcacgcaccaccacgcccagataatttttgtatttttagtagagacagggtttcaccatgttcgtcaggctggtcttgaactgctgacctcatgatctacccagctcggcctcctaaagtgctgggattacaggaatgagccactgaacctggccctgattttttgaattcatagtttcaagagctttacagctctgtcactacttacattttgtgatttttgtggaatgaaatttaataaatttgtgtaaacatacattcactgatgcagtccttcagtcattggacacccatgttgggtgctgggcattattctgggtactagtgaaatagataaagtccttgccttcatgggtcataccttctctgtggataaagacaacaataaaagagaaaccagataaatgaaaaaagtatgaaatacgttgtttggataataaatctgggtaatacgggggaaattaactgttattcctatatcattctgtagcctccccaaatattaggggcttccagggtaggataatgtttaagacctgttttcctctacagatctctgaagttcccgtccctctgttccctttaataaacaaatgtaattgactctgatttagagaaataggagaagcaggatgtttcagtgataaagagttaaaattcttcatactatagaggtaggccttagtttatagtagatgaactaaacaataatctaagagtctttgaaagttattgctaccaaatatcccaataaatggacacagagtacttttgattttctgcaactattgaattcttatgtgtatctatcatatctgtcatgtccatagactgaaaataacatatcctatatgcatacatgtgcactggctttaaaacatttattgaatgattttcatgtaacaaaaactgttctctgaattcttcaaggcattatccttgttgaaggctgttgattgatcatgaaccagataccgttaaaatccatgtttataagatagagattctgtaagttcctcaaagtctcctgactaatgtgcagtaagccaggattaaacacaggcattctccctccggaacccaagtctctaaccacagccggctttcatgtagatcctatggtaattttaaatgttattaaatttggcaaatacatagggtttctcatgttcaaaagagtggtgggccaccagtctagatgatcctctgtttattattttaaaattaaattgcccaggtaaaaatattctagaggctgtatgatactatatcggggatacatatcacaataaatttgtctaaacccatagaacataaaataccaacggtaaatcctgaagtaaactgacctttgagtgataatgatgtatcaacctaggtctataggttctaacaaatgcacctctctctttggtggcgtatgttgagaatggggaaggctgtgtggtgggggggataggggacagatgagaaacctctgtatcttcctcttcatttttctgtgaacttaaaactgctgtaaaaaatgaaatcgtttaacttattttagggtatcgagataaatcataaaggagaggcaacaactgagtccacataacatcttaacaaatgtcactggtcatccgcgactaattacaattttcaaattcagtaatatgcgtgtaaataacacatgtgaacaggggccagtcctcactctcaagcatggatgtaggctgaatgaagttatttcaatgccaggagtgcagactataaaggctgtacagggtcagagagagaggttttggtagaactgcagtgctcagggaaaccttcagaagacaggcaagctttccataggaagggaaatgacaaaaataacttcgagaaataaagagtatgtgtattccatgtacaaaaatgagtatttgataagtcacggtggtcgaagttcagaccccaggcttaagtgatgatgagttggccagcttggttagttaagaacattcccataagggggaagggggaagatgacagataagtaaagggagcttaatcacgtggtattttaataccttcgtattttaatgtaagctgtgaaaggtacaagaacctagaacctgtatgttcatagtgctttagagaagtttccttggctatagattggattttggagtaaaatgtctgaaagatgaaaatttggctgagagctatgaaacgagaatatctgagacaggtctcggtcaatttagaaagtttattttgccaaggttaaggacgcgcagtcccgtgacacagcctcaggaagtcctgatgacatgtgcccaaggtggttgggcacagcttgacgttacacattgtagggaaacatgagacatcaatcaatgtatctaggaagtacattgggctgggcgcggtgactcacggctgtaatcctagtactttggaaggctgaggtgggcaggtcatgaggtcaggagatcaagacgatcctggctaatatggtgaaaccccgtctctactaaaaatacccccccaaaaaaaattagcctggcatggtgacacatgcatatagatagccccagctacttggaaggctgaggcaggagaatcgcttgaatccgggaggcaggggttgcagtgacccaagatcacacgactgcactctagcctgggcgacagagcgagactccgtctcaaaaaaataaaaaaaataaaaaaaagaagtactttggtttttggtttggtccagaaaggcaggacaacttcaagcagggagggggcttccatgtcataggtagataggagacaagctgttacattcttttgagtttctgattagtcttttcaaaggaagcaatcagatacgcatttatttcagagagcagaaggaaggctttgagctctgtcttttgtccacaaggaaattcccgtggacaaatcgtgagggaggtacgtagcaatttttatcttagaagctgtctttttttggaataggatgggaggcaggtttgccctaagcagttcccagcttgacttttccctttggcttagtgatttgggggtcccgagattgactttccttcacagagtctccctgaatttgaagtatgtgatgacatggacaataaagaaaccatttgtgacctttgaaaataactgcaaactgtgatattagtgttaaaagaaaacctagaaaatagaagagttaaaaagaataggacctggccaggcatggaggtgcacacctgtggtcccagctactcaggaggctgaggcaggagaatggcttgagcctaggaatttggggctgtagtgagctatgatcacatctatgaatagtcagtgtactccagcctgggaagcgtagggagacctcatctctgaaagaataagttttgagaaaatgaatactaaaatgaaagatcacccatttgaaaaaatggaaggagaaaaatcccgttgttttacctcaataccactctgcctaatgggctgttttgattgatgcatatttaaaataaaaaaatgtaaaattaaagaagcagactcaagtgaaaaaagaggaacagtataggactaatgtccccacatagttagagaagaatgagattcaagagctaaacaagtttggaatattgaggctgacacagccagaacacacctccaggaagtcctcctaccatccagctgttttctccactctactcacataagatgcaccatgcatccctgtatcacattatacaaagttatgatgtttttgctattccttcttccctatctacctctccatgaaccttgaacttgttattggcagagaacatttcttgctcatggccgtcacccaaggggtgagcatggtgtctcacatttcattactgaaacactggccaaattaaggaattaagaggagcttgaagggagagcaaccctgacactcagaagattccagtgggccctgggaacttccgagaggatgtggagaagaaagctgtgtagtgtagtcagtatcacagcacccagagaagattggcctctggacaggagttgacgttttcccatgatgagctttgttccaggaaccatggcagaaataaggcaggtgacctcttggggattggcccactgtcaatgaggcaaaactgggaatctggtcagtgtttaagcaattaagtcagaagaataccatagagtcttgtctagcacctcacagtatgatgagaaagtagttcatgactgctatggtagaaatttaaaaatttgagaattccagggagggcccgtataagaaacaataggaactagaattaggcatgatgtgagatcatcctgatttgcacgttatcggggggtttgcaggctgcaggacttttcagttataaaatggtgaccatcggcaaaccaggacagttggtcagtccttgtctgctgcagcctcacggaccccacatggctttgcctgcagaatccttggaaacgctctcacccatggctcacagtcttcccggccctcttcatgtggctgctccttgttccttaactcagacattatgtcttagatattttctttttatcaaccccttcaactcccatgtggtcgaccatagccaggagcttcaaggacggtctactctttaaaaatcctggccacgaaaagcaaccgggatatgtgtttgggaagcagaacctcagttttttgtttcgttttgttgttttactttgtttttaatacattctttttttgtttttaaatttcctttaatgagtttctccctttctcataactaagaaaacgtacatcttaagacttgactgttgggagtggcttgcagaggacttgagtgaggtcggtaagtagccatgatttccctgtgaggtcaggccaggggctgctggtttccagaagggacagggggcaggttttcagcaggtggagcccctgggctgagtaccagggtgccaggggtattcagcatacagcaagtcccatttgtagggtaggttgtgtgccccgcattatcataattcaggatagtaggactgagctctgctgtacaagagggcactgaagatggattgagacagaggagagctcataaaacgagagctgcagtttatttgccataaactagttatagggagtgaggagaaaatgtccccaaactgagttcatggcacctgccaaatcacaggagtgtgtttgagaagtgtgaaaacactggcccattaaaacctcttcgactttatctgctgtggttagatttgaacaatgatttaaaggttaaaatttagcattccactgctgggctagatagctacagattcccaatgtagtgtacctggaccttcaggaaattgggttgaaaataagcgtagttaaggcaggcaggtagatgttcctttcactccatcaaggcagacatgacaggcatagatggagtgcagaaaataatttttgccacagttcctggaaggagaagtgtggccatttcccaagataacataacaaatggtatttgctctatagaacccttttcatgggacataaggtcagaagcggggaaaaatacaaataaccttcacaggcggagagttccatcaatgataaaattgtcaagaaggatgttatcaagatgaatataattactcaatatgttgcaagaaggtggttgctttagtaataggtgtctatctaggtgagtgggcccagtgactttgaaataacagcctgtggtagaggttatcaggaaagaaaattaaactaaggcttacagctgaaattcacactctccacctattcattctgctgacaggttggctttcccatttaatttctgctcaccagcccatccctaggagtttgctgctgatttgcagtttctttgggtaacattctttgattccttcacttccttcccttgcagttaaaatgtcctctgctatttcattctgtcataaagatggggaaaatccatttaaaaatacccaggtaccattttaaaggtgcatgtttcaaagcacggcgtaaaaataattttggccagtcacggtggctcatgcctgtaatcccagcactttgggaggccacggcaggcagatcatgagctcaagagagcaagaccagcctggccaacatggtgaaaccccacctctactaaaaatagaaaaattagccgggcatggtgacatgcacctatagtcccagctgctcaggaggctgaggcagcagaattgcttgaacccggcaggaagaggttgcagtgagccgagatcgcaccagtgaactccagcctggtgacagagtgagattctgtctcaaaaataaaataataatatcaagatttcagatccctgtgaaacaactgcagtataatgattcaattcataaaatcctgctgaaatgctgagattatttcacaaaaggattgtgtgaataactgtattcacatgactgaggaacaagcatgctttttgctaaaatataatattttagaattcatcctttttctgaagtgcgatgtgtcatgacagatagattttccaggaaataccactcaaatatcataatttatattacccagtaaaacttttaaaatacaaattttgatatttccttaaattctgcaactttcttcttttttggctgttgaatattctgaaattttgaatgtgttagcaacattcccccatttactcattcaaaactataggtgaagggaagtagctgttttaattttttccactgctttttacttaaattagtcactaaactgttaggtcgtcctcttcaggattgaaagcaagggaaatttcattaagacttgttggtctagaaattttcacagcctaaaatcatgcaaagagaaaaaactgcactgacatgtaaataacactgtgagggtaatcttaaattatgagcattgtaataagtctttcacaatatcatgaatttgttgaaatagaaaaacaaattatagaaggctttgtaactcttctccgtataatgttaccaatgcttcaaacccattctcttctctaaacccattgctttatttatttatttttaaattacgattctttagcactacgcttacggcagtaatacagcccacttcctgcaggggagaaagtgataacatttgtagctgtgtattaaaacaggctttccttcttacctccatagtagttttaatcattcatataaacatacaatgagtctagtattaaaggcaccagaaagggacttttgtgaccccatagataaattccatatggagttagcctaaaccaccatcattttaatagaagaggtcatcaggtacagaaataactgcagccaaagacgatctgcagttcatttggccaggaaccaaagcaaaggcatttcgcaaaaaaaagattacttgggtgcctcagatacagtctttgtcttacaccttttctgtcctctgaactagaaaagatcttactgaactgtgttattcagcttttcaaaaatgtattgtaacttgaatattcttaataatccttatgatactttaaaacttctctgagaagttatccaagaaatacgtcataaagaaaacccttttttccccacaaatccttctaatataaatgcatacccattaaatcatgttttcttatttcttatgaaacatatagacaattttagatgacaaatatgactctacaatgtggaaaaaatcattctggaaatgagcattatgaagatcaagtatttgactagcaaaacccaaatataccttcctacatatccaaaattagggagctggtgaactttgtttccatactgttacgcttggtttaatacatgcaaaatcacctcacagtaggatctgaacacaaaagaataaacctattgaaatttccagatttggggcctgttacctttgctgaattcaggcattatatgatcactaagttacctgttgggttgagaacaaatttatcaatacaggtgcaaatgtattcactcttgaataaagcaagttattatgtggacagcagaagattgtattcatatgaacagacaatttagttctataacttcctctgggtaattgataccagaattggaaaatggccatttcttgaaaaataagaaagtgaatgctttaatggacaatcacattcttgtgctgttagcacactgacgtgagttatagaatttatgtcaatcttcatttcccctgtctacaacaggcatcacatcagaccacttgcgatgtttacagagctgttctcacaaagcacggggagttttgagtcttgggttatctccgcagtgctgtaattgactcactgcatgaggtaatgagatgacatttgtggagtgctacacgaatctcatatgaaaataactatgtaaataggaagcattgttcttaggtaaagacccccccaaatggctctgaagtcaacatgacattcagttgaataaaatatagggagtgttcactctctgactgctgcttagtgggagaccatttaattaagagccattttggagaattttccttggtattctaatgaagttcaatgcattttgcttattatcaccatacaagtgcttacgcctgctggcagcagggacccggggagatggctcacccttcttggtttggtatagcaggtgtcagagcattaattaggccacgctcaacctgatagtccattattttgggcacttacagctttttagttctggtgacttgacctgcatcccaagcccatgctttttcagttttttgacatagattcattatgttagatcaatatacatattgaaatttgtatctgaagctaagacgtaagatataaggattgatatttaaaacccaaagaatcttgactctcgtacactcacaaaaaactcctagaatcaaataccttagaaccttagaatcaaatacctcatacaatcctccaatttctacatgaatgtagaaagctttaaaactgggtaagagagtgaactgagccatagggcaatcaattagatatcatctaaaaatggaacagtgtaggtacttgaaatacacaccagatagaatcaagaagcagtgaaagatgctacagatagagttaaatgtctaggatgtgaaagatcaaccatcacaattcacatatgacatgtcgttatccagattggctcctgacacaggcatgcaggagatgagtgtgtgtgtgtgtgtgtgtgtgtgtatgtatgtatgtgtgtttgtgtgtatctgtctgtgcatgcattccctgaaatcattagtgaaggagggtgacaaaaggagggaaccagaaatagaagaagaacctagtgtggaaaggggaggtgactctttctgtttagctatcttgaaagatcaaaaacagcggcagctcattttaagccttcacggatttagctgtgagtaacacttcataattcaccgggaaaatacagagtaactacctttcttgttaaattcttgtgatgctcctataaaatttctgcaatttcttatttcccaaataaaccaagaaaccttcccagagatcgtgtcttctggcatctcttctacaatttgcttctaaattgatcaggtggacttagtgttgactaaattatcaacattgaaagtttttcattttctttccactctagtacgtatttttatgacatttgtaagctatatcacgttacttaatgtactttagtcctgttcgatctggctcttctccatctatgcatctgtcttcacacatcatcctctgtcctcagtaaggctccttgtcctccttcatctgatagtgccagcatcctgtggctaccaggggcctggagatgcagtcatcagaaagcctcttccttggctctgatgctcacactaagacccctgcctctctggctggcagcggtgctcttccctggcccatggtctgtgtgctatggcagcttttatcgaccacagagttagcctgcacaggggccggctcgcctgaagctcagcctcagaagacatctgccatgggtgcatggagttcgctggctggtgccatgtgccagcatcatgagtggtcttgccacctccctgtgtgccgttcaggactggagacgtgtctcctccacttccaagtgcgtctccattcttccagcaccaggaaatccacctctgtctggtcttgggccatcgcctgctcagggtttgcctccttccttctctccctgcagctcattgcatcttgaggctttcatggttctaacctttcaaatgggtctctgaagcgaaggagaaggatcttttcttctgatcttaggttcatggctgaggcccccatgacaaaatagttaaaagcctacaaatttatgtaatatgagccttcgtaaggaaatgaaaacccagagcaacaggtcaacttgtatatttcacttatggctttgatgaagaggtagccagacgtcgggacgtgagactggacgaaggacttgtgatctaatgcttataaatcagcagggatgtagcaggggctgtttgctcaggttcttcgctgtgctcccgtgttttcagagacaggttatttcttttctctaggtatggggaggccccctctcgcacaaggcctacttatggcctacatcgggggagaagagcaagggcaggtgacagtggccttcctgcctctgcagttttctcaaatgtcagagtgccatatttagggttagggtgtcctgaatccaatcaatcaggaatggcatgattgcatatatgttcgttttaatgggccgttgaaaagaaagcattccttcactctcgtgcttggcaagaggaaaatccaagacagctccgaaagaaaagccttactaactccaaaggtgaaagaagggtacgttccttgcactgcttctcttcttgagtgtagggaatagcacataatttggcatctcaaattttctgacacagcttctgtaacgaaaaagtgaatgacacaaccagagtcatccaagacaagataaaactgccaattacctcccttcataaaacaactgtggaattaaattgagaaaataaggttttaaaatcagcagtctttgccgtttttatttgtgtttataacaacgtcagtgcttttaaagatgatccagtaagtttcttcatagagttcattttgagaatcaaggtggccatggcccaaagggaaatcaacctctcttttagcaaacctataaatatgagtcatggcaaattgaaagtaatggcaaaaactccaattacttttgcaccgacctaataaatatttttttctcaccaacagatttgaaacgtaatttcttaaaaagaatgttcagaatttattttaccgtttcacttccttgtactcaattttcaaatttaattgattttgtttcctgtgaagtttctctgtgaagtacatggtgtgatggtgtgcttacgtttttctttctttctttctttctttctttttttcttttaaagaaggagtctcattctgtcacccaggctgcagtgcagtggtgtgatctcgactcactgcaacctccgcctcctgagttctaagcgattctcctgcctcagcctcccgggtagctgggattacaggcacgtgccaccacactcagctagtattttgtatttttagtagagatggggttttgccatgttggccaggctggtctcgaactcctgacctaaggtgatctgcctgcctcagcctcccaaagtgctgggattacaggcatgagccaacacgcctggccatgattaagtttttgatatgatgcatgtggtaagtagacctgtacttgtgtttattttctcccatgcagcactttgtttacggccattattctcatttgagattccttgtgccctttcttgtccattatgtttgtttacaacatacaatgattatttccattgcctttatgagttgaatcttcataataatagaaggcagtaaatatgttggagttgctcgataactgggtaagggtcagaagaatcatgttggaagctgctatatttgatttctgagtcccgttgttctatgttagtgtcactttttttcttactatcattaaaataggcttccatttcagcaattgggagcaaatgtaaaaggcaagattattagtgaattttacagttttgttgagtaagtgattgattagtagaagaagaaagagtagcacaggtttgtctattatattctttaacatgaataagctatctcttttttacttactgttctcaataattaaaattgcaaaatcaaatcagttgaaatttatgattaattatttatagttcaaaatatttttacagctatccttcattccctgagacagggaaagcgtatgtatgatgtttcacatgtattatttcacttaattgccttataatccttacattcaattaatatcattcctaattttcaaaagagggttcagacaggctaacagggccaaagcacccagtatgaaagtggcaaagcctagatttgaaaatctctatgtttttttgaaaacagagatttatttgaaagtaaatctctctccagccggggtgatccagcaagaccccgtctcaaaacaaaccaaaaaattatccatttcaaaaagcaagatgcgagctttaaggtttggaaagtattgaaatttgatgagtaagtttcttcatagagttcattttgagaatcaagaaggtaggttatatgttgttggacaaacagaaaaccgatttttaccaagtctgcgctcctattttttgcacgattaaaaatcaatgcacacttattgtagaaagttgtccgaagtataaagaagaaaatccactgaacttctcgtgtccttattcataaataaccttatggtatttaaggtttttgcattccttgtctattgacgtgtgtatatgaaatcattatcattttatgtaatatgctttttcacttgtacaaaattccctggatttttaaatgttcttctaaacttacaaaaattgtaaaatgccatcatactgatgtacaaccattcacttgagcaatactcagtcagtgatactgaatattttctcagatttcactgtgataaatatcttttgattaaaaactcttcttgtatatgacatgctgctcacatatctaattagtcctttcctataaagttcttgacaattagtgatccaaatgaacagattcatattccaaggagtaattgtctacttgttcttatttttactgccattttttcttgtagccttagtgcctagaaaagtttcatagatgtatgtctgagctaattgtgcaaaaatgggaaatttactaccagtaaatcaggacccctggtgggaccccaaggaaacagagccactggactggctgggagtccccacactccagggccgccttctctgcgaggttcctcgtcatttcctcaactgtctgatgaaaggttttctggctccactaccaacagtgattcacaatagaacgtgcctctaggtgctaatttactgtcctggcacaatcccttacagagatgggatagcctcccctgttgtccactctacttgtgcaggagtggagtctgatagacttcccttaatcaagtgtgtccttcaggatataatgagtgtgtaaatgtaaggacaggtctcagaaaaggagagcaagagggtttcggcttggagaaccactccaaatgggcctgtgtacctagttggaaatgcatttactattaaatgtactttggattttgcttttctttttatcttaattacttttaacatatctttctgaaaaggaaattgagatcattagactcttcatggtaatactaagttgtttcatgaacatattacccttagaataagtaaaatttgtaaaaacattaacagatcagaactgaccatactaattcataagttacatgtaaataatagtacaaattgaaacttctcttaatttctaaattctatgccacaatgacattggactattctaatacttatatttcacaagaagtgagataatttggatgtgtttatgtgtgactatatatatatatatatatatatatatatatatatatatgaagatacttattgctcctaaagaaatgagagaaacatttctctaaaaatgttccaaagttattaaaatattaagaaaatatgtagtcactatttagtagtctttggataaaaacatttcagtgtatttagtttaatgtgaaatcatattcttatatataatgttgcttcgtatatacttactgaaggatttaaactattttttcaagctaagacagcaacgtaatattggacaaataatatagaattagagtatcatttttccaaggtaagaagctgtacactattgtgatctgtaatatcctaaaatccaaaattacaaataaatacctttaagaagcctatgtccttagagtgttcagactgcatcatacatttatgtattatcttatctgtttttaaaacaactgttctaattggatttttttctgatgctaatgaaaaacattctttttcctgtatctttcatattattctatttttcatatagaaatattattcctatgaaaaaaaattcatagcaaatcatcgaaatttgaaaattactaaatgcatacctgaggacacagatacacaacaagtaatttaaatacagcattctgactaatcaaaaaaagcatttttcagtctaagcacagtggcttgtgcttgtattcctagaactttgggaggctaaggcaggtggattgctttagccccaggagtttgagaccagcctgggcaacatagtgaaatcccatctctacaaaaacaattcaaaaatttagccaggcatggtggtgtgtgcctgtagtcccagttatccagatacttgggaggctgaggcatgagaattgcttgagcccaggaggcggaggttgcagtgagctgagatcaccccacagcacttcagcctgggtgacagagtgagaccctgtctcaaaataacaacaacaaatttatccaataaaatgacataaacctttcaagcgtattaataacgctttccacagaaacacaagaaagcaaagaaaataaatcaacacttcctagtgaccaagcacgaggtagggcttactctgaacatttgttctgagcatttttttctgcagagttaccttcctcaccttacggaggagaaaatggaggttatcagaggttttatgactttcttaaaattatttagataacatggggtaaatacctctttatcttttcagaggatgctaatttttcacaataggtctaggcttcttttttgttaattctgccttaaagtcgggttattttgtatgaggaaaaggggggatgtatgagagcaggattgacgtgccagcaaccaagcacatagtgaagccacagagtaatatttaccaggctcgagttccactcgtcgtattttcaatagcaagcaccagaaagcacaactaacattggcgtaaacaacaaaggaaagatcttggcttacctaacaacgtattgagacatcatttgtgctcaccatttgtggtttcatttcaccaaagtccagtgactggaaaagctggggttttgtaaagatgatggaaagagggaaatagatactgaagagacagcaagaatgcccactgaaattagcaaaccatattggtggtttcaacaccacttatatcagatattgtactacctcttttcaaatgtaacgatacaaagtagaagttaaaagccaagcagactggatttattcatatcgatatctagggtcttattttcaaatgacctctctcatttcctacagaaaatgcaattgccaaaaatagattaccttctcaagaagtattgttggccattcatgcctatgtcaaaaattgtttgctttcatcttcgttaatcaggagagacattaattatttttcattacgtagccataatgcaagttaatttttctgaatttaaaaaacaaggaggtttccagaggttgcatgactttctcattctctctctctctctctctctctctctcacacacacacacacacacacacacatcaatatagatagattaggggtttgtgtgtgtgtgtgtgtgcttatcatatcacattgaaaactatcttagggttgggtacagtggctcacacttataatcccaacactttgggaggccaaggcgggtggatcacctgaagtcaagagatcaagaccatcctggccaacatggtgaaacctcgtctctactaaaaatacaaaaaatagctgggtgtggtgggcctcacctgtaatcccagctactcgggaggctgaggcgggagagtcacttgaacctgggaggcagaggttgcagtgagccaagatcatgccactgcactccagcctggcaacagaggaagactctgtcacaaaaacaaacacaaaaactatcttagaatgtggtggccccctatcaagctggctcaccatcagcagttccaatttccatttctccttcctccctctctataatttaatgcatctgcccagtgtcatcaagtgtgaaggtacgatgatgagaacatggtacgtcactcaatgtagtttcaaagggtgaaggaaattcaccagaaagtgcacttgtattgaacagtaacattagtagggaaagatacgaggttgaattaagtgacccggtgctttcagatttttgattcatattactttttcggtcgaattttccttgtaaaatattagtgataacataacatgtatttttgaaaatcagcggaatgtccagaagcacagcatgcatttttgcagaacacaattagatctgaagaaattcctaagaacaggtctgattctacatacactgctgtgtatattcatagttgtccttttaccaaatactgtgcaaggtatctatgatttgtgaaatatatttaaatcatgttaatgtcatattgttttattcacatcatttgcatacattgctaagattaaagtacttgaagagtactaaaacaaattacaagctgttatcgctaatattctagaaatatggttctaaatctgccctgttaataaaaacttgcaattaatttgggaaacagcaatctatttttaaaattaaatgagcatttctattgcatttattatgcattgtatatattttacatatttaatctattacatatttaaataaacatttaaaataattatgcattttataatatttatacacatattacttagcataaagcttcatttaaagaaataagtagttacagaaactaataaatttcaaatccagcaaaaatccactgagtgtctgggttcttgtagatagttatgttgtttgatcctcctaacttcctagtaagatattatcttttgtagatacattatcattaaagaaggacgatgattaagagaacttattgcagttttcatagtgtgaaaaaaattatctgtgctcctcaaatttggcattttggggccaatgccagaagcgaagtctagactcatgaaattctagaatagtgataggtatatagagggagtgaggatgactagtctaaaaataaacagggcggaattactactttaattattattttaattcgttgttaggcacatccattttaaatttcaacaaagttaaaaaatgtttaatatttcattgtttatcaaaaatgggcagaaggtgtcaacttcgcccttcatgcatctgcagagtaaggtcaagctaccttctcgggtgttcacgtcagcagctggactcaggaaagcaacagtgccatgtgtccagggaaagccctgcaaagacagctcccagagccagattcaatagaacttgcgttgtggttgatcttggccatatcaagaagggaaagtacattgacagaaaaagaaacttgcgcagatgaccagatgtgaggctacctgagggaggaatagagtcacgaacctcactgtgatctgggcaaacaatgaaccatcttgggcaggtccctgttgttctgtgggtgaggttgagagtcggcagcacacaactcttagcatagctggtaaggttggctggtttggtttatgtagttaagtacaatctatttgtttgtcaaatattactgtttgtaaactttttacaatgacagaatttcagttactgggcagtgactgaggaaacattgatagcaaaaaccacacccttgctacatacaggttaaaggtaacttgctcaaaggtaagacgagagacaactttcctgtagatatttattttgaaattagcacatgtgtttaacaacagggtccttgaagacatttttatcttatttggatgccttctgttgaaaggtatccatttccctgataaataaataggtagcacatgtttttagtagtaatgtaaatgcatattgtaatttatttcttcacttaatttctgaatataatgttagattccatcaaaaagcagaattattgctgaaattcactgaacattaattctacagtaactcaagaactatcatgtgtagttacctggccatataaatgataataaaaatgtgatagtttttagttttgttaacaaattctttttttttgttgttgagacagagtcttgctctgttgcccaggctggaatgcagtcacatgatcttggctcactgcaacctccacctcttgggttcaggttattctcatgcctcaccctcccaagtagttgggactacaggtgcgtgccaccacacctggctaatttttgtattttcattagagacagggtttcaccaggttggccaggctgacctcgaactcccggcctcatgtgatctacacgcctcagcctcctaaagcactgggattacagaagtggccaaaaaaaaaagaaaaattctttttagactgttttgctccttccagcttgataagagagttcctttaattcatatgtgggtgtgtgtccatgtgtgctgttactaaaatagttcccatttggttttatatttgtttgtttatcactgtctctgacatcaaaccatggaaggcaggctttatgtctatttcattttttttctagtgttttatacctacggaatcaatatatagttcattaaatgtcacactttacagcattcagatgtgttaatacttcattttaaagacattcttcagcttcgtttctcctccatccttgcctcctttttgttcttcttttgtcatttttacattaccttctgttttccattctcctttttgctcacaagtatttgatgagcatctgttgcctgccaagaactctaatgggttttctgcatctaacggtgagtcaaagtagaactcatgaaattcacaattagtcagagagattaattaatgattacataaagaaatataaaaatgcagcagtgataaatgctataaagaaaaattacttaggcactatgaaagcatcaaagtgagtattcttgatgtagtgcagattataaggaaatccttcactggaaaatttcttctggcttgaacatataaaaatgattagagaataactatataaattgtagtgtgttgaaacaaggttggagagagaacgagagagagagagagaatctgtctctaattcaaatgccttatgttgaaactctgtcccattatccaagataaataaataggtagcacatgtttataatgataaactaattgtatattgtaatttctttcttcactttaatttctaactacattgttggattccttcaacaaagtagaattatttctaaaattccctgagcattatttctacagtaacttaagaactattatgtatagttacctgaccatataaatgataaaatccgatagagatataatgtatatattattttatgtatcatatatattatatatgtatatatgatagatattataatatatatccctatatatatcatatctctatatataattctatatatataattctctctatataaaattctatgtaaaattctatataaaattttatatatatataaaatatataatatatattatatatgatagatatatataatttctctatatatatcatctctctctatgtatataaaattcctgtatatctaaaatctctctctatatataaaatatgtatatctctctctcaatatataaaattccaggacagaagaacaaaacattcaaagccattttataaaatgagcaactcgctgaagagaacaaagaaaagctttggtgggctaagaacaaactaagggcaggagggctgggggagagatctagaaacacaaactatgacgtgacattgatacgctacataggctataataaaattgttcttttttcctttgtaacttggaaaacagattgctgcaggtgcgaaaggagaatggagataagaagtccgttaaagggtgccgtggtagctggtagcttgtgctaaactggtgctagtgatgatgtagaccaacaggaaattatgagatatattcggaaggcaaaattagcaggacctgtgataagttgaaggagagttgaagataggaatgaagacatactccagcagctgcagaggctcccagaagtggttgaggggtggatggggaagtcaaagtcaaggacatagctaatattagggcagtggtgcagttcagggcagatggatacaggagcttctgtttcagtgtttggcagggaatgagaaacatggctaatttatcttaatatatagagggagggtgtcataagcaaaggagaagagcaactctaaagaatcttcaatcccaagtaccacaaaactattcaatgcctaggtcagggtctatgaccttgataatatagaaaacatgtctgtttatatgacaaaacatcttatgcatagcagaattgtgtaattaccactcagcaatatgggggatcatcgcttctctttctactttctaggactgttgaaaggataaaagtgaataatttgcttcaaaaactgcaaggccaaatgtaaagcaaatgtgaagaattgctattatctataaaaggcagacacatccataaaacaaatcattcaatccaggcttaacgtttatttttctctttttctactagtatgatagtttagatactttttgtttaggaaacaattaggcaccttactacactgcataaatgtgatgattagagtacctttggctttcgttcaaagaaaacagagtacctgaatgtaaacacaggcttactgttgacaagtagaatgcaatgtaagggagtacagatgaatagggaaaatatgcaaaaaaaataccaaatataactcttggatttttacttaaacagctcaattttgagattgccagaaagatatcctgcttactttttttatgtttattctgtcctcattgtaatcactgctgctactaccacctcaacttaggcctttattgtctctacattgaaatatcaaaccattctcagaacttgtccctccattacagtcttgattctggtttgatttatgacttgttatccgtgtattgttctttatttaatgttcttacaatcctgaggctcagcaaagttaaatatgacaaaaacagtcagccagctcagaaatgataaacttaaggttttgccctgtatttttcaaatgtcaaacatttctctacactcatttattttacaaataacttttgatgttgataactctctttaggctccaacaatgccccttcagagataagaagtgaaagttttaagtgttttaaatactgcatggtgtataagtattggaaaaagaattgttcactagaacaggttaggttctaaggtttaaaactaaagaaaaaactgaaactatataaatgttatgtgttagtcagctcaggctgccataacaaaataccatggattgggtggcttaaacaacaagaatttattcctcgcagttctggagccctgtgcgtccaacactaaggtgcagccagtttagttccctggggaaggctctcttcttggtttggagacagctgcctcctcaccgtgtcctctcatggaggagaatgaggaagcagcctctctagcatctcttcttataaagggactaatgccatcatgagagtctccaccttctaacgtcatgtaaagctaatcacctcctaaatgccccacctccagatatcacattgggggcttagcactttaacacatgaattttggagggggacacgattcaatctatagcatgctgatactctaggccaggaaaccttgcattttcttctatatgtatttgcactactctcttctacattccatatattagggtttgtttttgttgttgttattgttgttctgttttgtttgttttaccaaacactattatttgtctccttggtgttcctgatttgcaccaaagcttcaagtaccagaacggttagtggtacatctttgttcaatactattatggtcaagttgctcctctcctgctgattttactgagtacgtactgttccctcattccctttgagcatttatacacacagcctcctctgccaggtgtttgagaccttcccatcctggcatcaccctacctgtttccacttgcctttaccttcttcagaactttttttcaacctatcctggcatcaacctatctatttccacttgcgtttaccttccttagcatttttttcagcctcaatccaggtccatccctgtgccctgcacatgccagactcaacataacctcccgcttttttcaactcaggaccactaggtccaacccctccagtgaacaaataattgtatggccaaaattttgaggtctgaccattagatcgattttcccacctcatctatggttccagtggacatctgctgtgagatggccaatgtttgaatctggtttatataaagagaataatgcatataagtgagaaagtctccatttagaattttaataatagctttattgagatatacttctcataccgtaagatttgcctctgtatagtgcacaattcgatggtttttaatatattcacagaggtgtgcaatcacctcctttattaattttagggctttttatctatcctcccaaaccctgtatctttcagcaatcattaccattccccagcccctcacttccatcacgggcagtccctggcaagcactcaattgcttttagtctctgtggatatatgtattctgaacacttcatacaaacttaatcatacaatgtgtgaccttttgtgactggcttcttacacttagcattatgtcgtcaagatttaattgaccagctgtgggttttcttgggggaaaatgttgaggaagcattagcagagttgatgtaaatgaggactagaaccacaaagcatgattcctagaatagaggtagtctgtgaattgcccccagagtttcccccaagcacaaggtagaaagtaggtgctagatattaaaggggaactaactgagagctgttttgtaggaaactcttccaacaaaacacatagcaatcatttcctgaggttttagataatgtggccaatgatatcaagtgtgcctcaacacctctgggccctaggttggaaaggaggataatccttacagatggcagcaggtcacctatagacagcatgctaaaccctttcaaaggatgatctgtaaaactaactttgccctggagtctttgggtcttgcattttatgcgttttaatagtttttgtgactttttcatgagaattcataagggactcttacaaaaagtttttttaaataaacatttggcataaattttaacattgtacctgataaatgtcttttctttctttctttttccttccatagaatccctttttcccctcaatgtcctcagtttgctacagatgtgtgtgtgccatgtcaccatgcttgtgtgttgtttcaccttgtgtgtgtgtgccatgtcagcatgtttgtgtgtgtgttgtgtcaccgtgtgcgtgtgtgccatgtcaccatgtatgcatgcatatgtgtatgccactatggaaacgtgtgtgttatgtatgtgtgccgtgtcaccatgtatgcatgtgtatgtcgccatgtttgtgaatgtgtttgttgtctcatgtttcggtgtgctccatgttaccatgtatgcatgcatatgtgtacgtcactacatacgggagtgtgtgtgtgtgttttgttaccatgcatgtgagtgtaagtatgtgtgtcatgtcaccatgtatgcatgtgactgggtatgtcactgtatgagagtgcgtgtgttgtgtcaccatgtgtgcatgtgtgtgcgcagtcttacttcctttctcccctttctcccaaaactttttcaagcacctggcattatttgttattttattctttttaatttttctgcatacgtagcacattttatttacagtagggaatcagcaatagtcttacactttctgtgattggttgtttacattataggtgcatatttcaccaaagatccttattaaagctttttttcatcagtaatataaaaggaattattctccctcttttctcattgagaaaatgggttattttacatacactacaaatattttctgcccatacttcaaagtgtgagaatgtgaacaggctctaagtctctttacagttacttcaagtcagcatccaacccatctcaccttttaccctaggttgagaaatgaagttctagagaagttttcatttgggagagcacaagagatcaaaagcttcctgatatgtgtcctgtgacctgtgcacatataaccttctctgcagctgccattgtcctctcttcctgaggttccaggacacttggcaaatggaagccagcaggtatttcactgtgtgagagcctcatgcaatgggaagatcagtgaccaggtcctgtcactgtagaaagccgaattcttaaaggaaactctatctttcaacaaaaggtacaggactgccttggtgtcatcactgtcatgctctcagtaagccacccaaaccatgctggatgttctgagaaagcaaaacactgcctacctcggcgaggtgctgctccctactgagaaagctgacccactccactggcatgcttggcaacttagtggagggtttctatcttctcgtttttaagataatttaaaaagatgaagcataaatgaaactcctcaaacgtaagtttttcgctggctccttcaggctgagagcctcctggaggaaagcaggcatgcttgtgagcgtgcaagcacacacacacaagcacacacacacacacaagcaatactttctgacccatattttgaggtaagaaaaaataaatctataaactgaatcatgaaaacagttccattttaaaacgttttagttgaagctctctgtgctgagagaggaactgttgaagataacgttgtttgagactattcaaagtgtctggtgaattcacgtggagaggaaaaagtgatgcttatttggaagctggccagtcacactttgccgacatcactgctattattccagaacagtggcttttctgtcgtgcttccagaattatcacaataaacttgtctgccaaatgttaatttttctcctcatgaagagtttctagttgattacacaaacagacttgggtctgtaattttttttaagtagataaacagcatcaattaggtttaaaaaacaagaataaagaattgccatgttagcgtttccctagggcccattcagtaacctgccctaatagtcaccaagaaattatctaatgacttcaatggtaaaaggattgaatacttcatcttgaaaggaaactactaagaggaatggaatactaagcatcataggtacataaatcatgccgcaggatttgaagagagaatactgagtgcaaatgcagctagtttttcaagccacagattcaaaccagcagggttctgctttgtaatatttgcaatgactgtgttgagaattattagtggataaaacagcagccaatgtaggcaagcttaaggagcttcttgataaagctgtagtcaggagatagcatggatgtcatatgactgtttgttatatgactgctcaattaataaagctatccttgtcactaaaatttccttgttaaagtacccccatcaaaacatgccaccaccaaacacaaacacgttcttttgctcttctaagaaaagagtatgactttcatctgagcacatgaaacaaattatttttttctttatattataaatttttgtgtacttgtatttctcaaccacttagagccaactatttttttctggtctgccttaagagacgtgaatcctatcaaacctatcatagtaatatttggatgaacattttatattatagcaggtaacatttgcatagtgatattatcaaaatgcatgtcatacagaactgcctatagcaaagatgtgctttatttttatattaagggtaacgatcagaatataagacacagtatcccttgcagttagcacttttaattataataatgaattcaagtgggagtagttaaaagaccaccacgtatctagctcacaggacacacatgtttgctccttgactatccaaaacacacattttctttcccatgacttcacttattaggagaacatgtatttcattattagccacaatcttgacacggtcataaataagacaaagtcagctattccctagggccaaggccacaaaaaccatcaaaagaggcaaatgagagcttccaggagactaaaggccatgcctcttctacattatccacacaaagaacatgagagaaggcatagcagaaatatacatggagggactttagtttgcaaaaattaatgtgagtgtaggagatgaaaaactatatttctaaccctaccctaatcagaaagtttgccctatcttacacttgtggacgtgggggcaccaaaccagcttccctttctacagagtttctcctagcagggttcagatggttgagttcatttgttctggagcaacacttcactagtgttaatagatcttcagctcagcagctccaatcctcataaaacatgaaactcatgactttcaaaaataaaggagtatagcacactggggctctgcacctttcagcagttctagaagcccagaaacctgaggagttctgtgatttggctaagaaaccattcttcttggatgtctttccaaatattgctacttaaatcattctccttctagaaaaatatttgcagtaccccctacctctgaccctaagaaggtgaataaaactatgtaaagagggtttaagaaaagaaacagcagaaatgttcaagttagcaaaaaaccaacagcttcatactataaaatgttaagaactttgttggaaggttaaaaaaagtttctaaacagaaatacttagtagctaccctaatgcttccagagtgcttctctggagatgggtaaaaaaatctctgaaaattctcattgatatgtgtcaatttggaagaagtgggtaggcagaaaggaaagatgactagatacggttgtccacatcctgagttccaagtagttgttcctcaggaactagaaaaacaaaactacaactattttctcaaatgaggagaaatcatttgtatgattaccaaaaatctcatcgagaaatacggattggaggaattaccaattggagtgtaccttctgggtagagctaacttcttgtaaggatttttagtgaataaatataaacgataacagaggtaaaaatcagtagtaaatatgtctagcccccatctctgtcccattaagggaactaaaagcaagagagacagcaagagaaggcaaagtattcacatcccagccctaaaggaagcgaagaaggaaatagggagaaaacacatgccaaatgcagattttttaaagctgaagtaaagctttataagtctgtaaaaattaagagctgtgtaaattctgtgaaatataagatgaaagtaatatttcaaaggaaatgagtgagattaaaaggaagattagacacctaagaaaccaaattagaaataaagctaacactagttcagaaataatagatgaattagaaaaagagaataaaataaagcttcagagatctgaggaaacagattcaacctgaatttaatagaaaatacagagataaacatggtagagagaggataacagatatagagaagaaatcatggagaatgttgagcacttcattgagggattaaggaagagaacactggaaatggaaaactatctagagagaggttgtaggcaaactggtaatgttttatttttgggaggctgacgcggggagatcactaggtcaggaaatcgagaacatcctggctaacacgatgaaaccccatctctactaaaaatgcaaaaaaattagccaggcgtggtggcggacgcctgtattcccagcttctctggaggctgaggcaggagaatggcgtgaaccagggaggcggagcttgcagtgagctgagatcgtgccactgcactccagcctgggtgacagagcgagactccatctcaaataataataataataataataataataataataataataataataataatggaaaacatcaaaagcaagttagagtgctgtgtgtggcagtggctagagacgagggttcaaggcagcccaagaacccctaccaatgacagtgctgtgatcatccaagaaagctaagttacaaaatggaaaagcctacaaacgtggatgagatttgggtttgtggtttgggcttttcaacggaatgccccattatcaaagttggaaggatcagaagccataacagaagttattatactcaaatccatggcagtgcagttgattaaacttcagaaaactcattgagtttgatacgaggcaatatctgctaaaagctacacgtgcaaggtagaataagattaggtcaaattaatacgtgttaatgttacaaaataagagatgaggtatttcatgtagaatcgctatagcttaaaaaatggagtcgaaaatattgtagatttttaacaaatgcaatggcaggtaaaagaattgtttcaaagacgtatgtgtgaaccaggcaaagatggccactctaaccactgctattcaattccattagcagttttagccgtgcattaaggctagaaaaagctataaaaggtttacaaattggaaggataaaataagattatctttattcacaaaggacgtagtctatgtagaaaaattctaagcaatatacaagaatgttactgaaaccaaaagagtttaataatgccatgtgatttaaggtcaatattttaaaaatccattgaatttctttaaccaacaatcactgaagaaaattagaatttgtatttttttaatcccatatgcaatagcgttccaatacataaagtactcagggacaatccaagaaaatatataaaaatctgaattttgaactacaatacactaatataggaaaattttaaaaagacctacataaaaggagggtatatcatgttcatgaattggagtacttcatattattaagacatcagtttctttttttttttctaaattgttctctggattcaatgcaatccaaatcaaaatatcagcaggcattttgaagaaaaggacaaattcactctcgaatgtttgcagaaaagcagagaatctagaatggccaagacaattttaagaaagaagcactaaattggatcactaacacactctgatttcaagatttcttttcatgctacagtaatcaagactgtggtattggaaaacatgatagatagatagatataatctatggaacaaaatagagtccacaaataggcctacatatatgtggccgaacaatatttgagaaaggggacaaggtaacacaatggagaaaaaatagtcttttcaccaaaggattctgtaataactggacctgtacatgtagaagtttaaaaaatttacttatatctcacattatacacaaaagttaactcaaaatgattgatattcttacatatataaactaaaggaataaaaattacataaaaattttataaatgcttcacaaattgaggcaaagaactttttttttaattaggtaacacacaaaaagcaggagcactaaaataggagtttgataaatcagacttcatcaaaattataaagttctgctcttcaaaacacaccgttaagaaaatgaaaagatagactacagaatgtgagaacgtttttgcaaaatacatatctgatgaaggacttgactgtatgaagaactctcaaatctcagtaagaaaacagcacattttaaaataaaaaatatttggacactttgtttaattacagttatggattatttactattttcctgttgcttatataataagttaccacaatattattggtttgaaacagcataaatttgttattttacagttttagaagtcagaagtccaaaattggtcaaaaatcaaagtattatcaggattctgttccgttctggagggtcttagtaaaaattcacctttttgcctctcacagcttctagaggctgcccacattgcttgtctcctgtgctgtttcctcttcaaaccagtagttgctgattgagtccttatcatgttgactcactttcacactgactctgcctccctcttccatgttaaaagccctctctgattatattgggcccatctggctattccaaaatcatctttctattctaaggttagcttattagcaaccgtgattccatctgttaccttgattcccctccaccacattaaataatatattcacagtttccaggaagtaggacttagacatccttgggaggtcattattctgcatcccaggatgtgctgtatgacaggcacatcagaagatgctcagcgccccccagtcaccacagaaacgttacctagaagcaaaatgagattgtcctatgtgccagttactatggcttaaagcaaaaacaaaaaaaatgacaacaacaagtgctgctgccgatgcagagttcatgcaatattacatattcctaataggaacgcagagtggcacggtcatgttggcaaacatttgggtcattcttgtaaagtaaaatatatacctactatacaatcctgcaaggtcttcctaggtaattactcaagataaatgaaaacatgtctacaggaagacttttacataaatatttacagcaactttatatttgctaataaatggaaaacaaacacaaatattaatatgcaaatggtaaccacattgtttaatattcataccatagagcactactcagaacaaagaggaatagattatggatccatgcaacagcgtgggtggaccttgaatgcgttatgctaacgtggaataagccattgcaaaaggctgcatgcacactgtatgattctattaatatgacctgggaaaggcaaagctacagagatggaaatcatatcactgataaccagctgccaccctctgggggagagggctgaccacagaggagcaagaggatcttatcagtgtgctgggaatgcttgtgtgttagctgtggagtttgaatctctcatggttatgggttactcatggttatgtgtgacataactttcacgactcatggacccgttcacctaaaacgggtggtttactttttggaaattagtcttcagttaatttaccttacaaatttcaaagtcagcaaagggagaggaaggccaatctgagagaaaagagaaccagccaaactttgaagtttcagagaaagtgaaggagaggaaggtcgtgggagaacagagctctgaaagaagccgccagggtttggcaaatggacaaacagaaaagacctaagaaagcaaaaaatgcaggaggtttaatctagattgccagaaatacagagggcagggctgggtggcaaggtggaaggagagtaaagggaaactaataccttttctgcaaattaataattaaacagtttgaaaattaaaatatttggtaataataaaatgaagaacacgatgagatattattttcctttttcagatgctacaatttttcaatatatctaaaattcccaaacacattcctaatgcaagttttttatgtaaatagaaactgtaaagaagtaatatatatacattgtgttttataaagtttggatggatgtaatccatttgaaatgcatacaaagaagattttccctcaccataaagatgccataatttccatagttccaaactatgtgaataatttgattgtctctataagattagcatctacacttttatataaaataaaattttgcttttatttttgctgtgtatggctcccaacctgttataataataagcacatgtgaatttgacgtgacaatctgagaactcttgaaaacattttcttttcctttaaaaatgtatttatttttgttatttatttatttctttattttcaagacacgctcttgctgtattgccgagggtggaatgcagtggtatgatcacggctcactgcagccttgaactccccagggtaaagcagtcctcccaccttagcctctggagtagctgagaccacaggcgggaactaccaggaacattcaattttcgtttctactgtagacatggggtttcaccatgttgcccaggctggtctagaactcctgagctcaagtgatccgcccgcctcagccttccacagtgctgagattataggcgtgagccaccgtgcccagcattgaaaatctcttcttactagtcacacagaaataatattttagtgtttcttaaatgtccccaagataatgcaaagatgaaaactactccctgggctactttgagatgcgcagggagagtatctctctctttaccagctggtgtacctgtccaggtgtgagaaattttaacagactctgatgaggctgtacgatgacgcacacacagaacccacacagttcacagaggcgatttcatgaggtagcttcatcagaacagcattgtgttgtggatctcttgcccgaaccagaaacaacaggagccacttcctcagtcttatctggattagctttccaatttccatcccagtggagccatcgtcagatgacactggattttgagaagaaccccaggatgcttttcctgatccagcccaggtatttgtgagaatctgaagtgtctgacgatcctggatttgttctgcctggaaccagaggcgctctgctacagcacttagtgcattagtccattctcacgttactttaaagaactacctgtgactgggcaatttatttaaaagagggatttagttgacctgcggttctgtaggctggaccggaagcatggctggggaggtctcagggaacttaaaacaatcatagtggaagggaaagtaggcatgtcttccttggctggagcaagaggaagagagtgaagggagagttgtcatgcacttttcaacagccaggtcttgtgagaactcactagcatgcactatcaggacaacagcaaggggaatatctgtgcccatgattcaatcacctcccaccaggcccctcctccaatattcagggttactactggacatgagatttcggcagggacattgacccaaaccaatcacttagcatcttccaaagagtcccttagaggaaagaaatacctgtagattctacgtagttttgctctgctctttcccctttaaaaagatgggctttgtccaatgtttgctctggtccctaactttgtgttatcgtgtatatacaggtaatgaaaagtcagcagtaaaaatcgggctgggataatgtgtctcaggcttgtcttgccaagagaaccagcacttcccagctgatccagtgggtttccagaggaaatgacacagatcccttctccgtggcgtcctaagcccacgtgatctggccctcctgtcctcaggggttggcttacttgactctctccagtcatgttagtcagctctgggctggaacagagatttttcagggaaatcaaaacaaaacaaaagccttctccacatgaaaaaggaaatcatgttgaagaacattccttaagagtaacctctttagcctttctttcctttttctttctctctttttgtcttttggctaactcattttggaataaacactgtcacccgcgtttccacaccatgacaagtgtcctgccacaatgttttgatgatgtgggcactcgtttgtcacctgagcttgaatccctggtggaaaaggaatgtgagcatcatccataggaacggtggagcaggaggtgtatgtgacgaataattgcgtaacatctgaaagtgcagtgtacaaatgctcctgaaagtagaccacaaaacgaagtggcggctgaaaggggttttatatttctgaagaacatgatgtgagaaatcgtagccgtcaagactggcattgttgggcacatgaatgacatctttacattagcattctccagggagacgagcgaaagtgcctgaaaaacacagatggacttttcaccaccagaaagcaccagtctgcagaaacaaagtgcttcactggagaaaataaaaagaaattagtgttattaaaagaaaagcgtgtcaatgtggtctttttgtagaatctaatgccttttcctcagcaatttcaggaacaatgcatgttcctataaatcgccccctctgctttccctcatttcctctgagtaattcattactcagttacttttagaaacctcttatttgtctacaaaataaaaatgtttattaaatttggtattaattataaaaaatcattatagcataactttgcaaacatgtcaggttattagaccctgtttaaggatttaatagggggttttcatttcctttgaaatttatatattgtactgcaatctattagaaaagaaaaagtgtaattgtggtgtttctctagtcccaaatttttatcttaatataatgtctcaacacagttacatcattgacctgtgtatgtccatgatataattgttcatcaaacattgctaatagagcaaaattatattgaatatgttgtaataactctgtaactatgtagaaactgtcaatataatcctattaaaagatactgattgtgatttacgtatattcttgtctcagcatgctaccgtccttcatctccatgataacattaacattctacaacttctgttacctaggactaacatattcttcatgctaaccgttttttggatataggattattacgatttaatggtcttataaaaacattgatcttagtctatattttgttttgaaattaaactttttattttgggacttttttacattcccatgaagttgtaaacaataatacggagagatatcttgtatctattgctcagtttccccttacggtaacatcttgcaaagccaggaaatagtacaacatcacagctaaggtattgagatgaacacattggagatacagaatatttatatcactacaaagatcctattctcatgtagagtcacattcacgttcctcctgaccccaccgcctaacccatagcaatgaataatctgttctccatttctatatttttgtcacttcaaaaatgttataaaaatcgaatcctatagcatacaacgtttgaggattggctttgtatactcagcctagttctctaaagatgtatccagtatatggcatgtatcagtcagcagtctgtttttatttgttgttattgtcgttgttttattgctgagtggtattagatgttatggatgtaacacaatttatttagccattcactcattaaaggacatctgggctgtttcagtttttgcttattccagataacgctgctataaaatttcatgtgcaggtttttgtgtgaatgttgtcacatttctaggataaatgcctagtagtacaattggtaggttgtatgatagttgcaggttgtgttttataaagaaactgccaactgtttcccggggtggctgtgccattttgcattccaaccagcaatgtatgtatgatccattttcttcttatgctaaccagattttgattttatcatttttcttttaagcttagccattattgtaagtgtgaagtgatatctcattgtagttgtaatttgcatttccctaatagctaatgttgttgagtaccttttaacatggtatttgccatctgcctatcttcagtgaaatgtcttcataattttgcccattttctaattggattgttggctttatggctgagttttgagagttctttatagattagagatgttagtcctttgtcaaatatgtgattttcaaatactttctgcggtctgtagcttgtcttttcattccctttacaggatttttcaaagaggaaatgtttttaattttgctgaactataatttataatattttttattttatagattgtgattttggtgtctattattttaaaattattttaggtattccagttcctttgtcttgccctatacattttagaataatcttctctatatctgcaaaagttgggttaggatttgtaatggaattgcaataaacctgtgtgtcaattttgggatcattgatatctttcctatgtttacttttctgacatggtatcttgcttaatcattactttcgtgttttctggttttcagcaaacacatcctgtatgtgttttgctagatttacacctaagtatttttgaatggctttaaattgtgttgcgtttttaactcttctgtccatgttacagacttaataaaatcacttactggttatgggaatttcttggtagattccttggggttttctacaaagaacattatgtcatctttaaatatggacagttttatttctccctttcagatgtatataaattttatttcgttcctttttttttttttttgcactggttgagaactcccaattatatattgaataagagtggacatcctttcttttatccaatcttaggagaaaatcatggagcctttcactattaagtataattatagttacaagttgagtatatactccttaccaatttgaggaaattcttcttcattcctagttttcagagtgttttgatcctgagtgggtgttgaattatgtcacatgcattttttccctgatggacatgatttttatgatttatttgatttttattgtttagcatgttaatatggatggttacatagattaatttaaaaattattaaaatgaaatttacttaatataaattaagcattctcaggaacaaatccgaggcgtcagtacattcacaatgttgtataactaccacctccatctgtatgagaaacagtttatcatccaaaaaggaaaccccatactcattaaacagtcactcccctgtcgccttggaaatggcctagactctggcaatcaccaatctgttttctgtgtctatggatataactcttctgggtatctgatatgtgtgaaattgtactgtctgtgacattttgtgcctggcttcttccacttagcatgttttcaaggttcatccatggtgcagcctgtgtcagtacttccttcatttgtgactgagtggtattccactgcaagtctatgtcacattatgtttgtagattctattgttttgctgttctgcatttttaaatatatctgctctaatctttttaatatttcattttacctgccagcttggagtttatttgtatctcctttctctaattccttcagttgtatagttagggtgttaattgatcttttcttcttttttaatgttggtatttgcagctatgcatttcctctgagcactgtttttctgattccatatatatttttgtgtgtcctcgttttcatttgtctccaggaaactttttattttctcatggaatttcttctttgacccatttttgtacttacatttttaatcggttattttatttgtatgtatttgtgaagttctctggttttcttgtttatgtatttttgtagtgtaccattttgacttccctctcatttccctttatgtattgttttcagttattgccttcgtggttaccacagacattacaattcacatcctaaaatcataacaatctagttctattaatatcaacgtattttcaataacatagaaaagttgtgctcctatatagctctagactcccaaccccagaccatgttcacataggaacatattatatcctcataaattgtgttaccattaacccagatgtgtggtgattgttttatgtatttgtcttttaaatcatatagaagaaaaatgagttagaaaccgaaagtataagaatagtgacttttatatttaccagtataatgactttgattgtagtttttaatttttctaacggcattgctttactttccgaagtctttttatttcattgtggatactccgcactggcattcattgtagcattttgcttttaaaaatttgtgaatatatttatttctagtttatcaatgtctgatttctgaagcatagtttgctgaatgtagaatagtgagtttgatagagtttttgtttttgtttttgcttttttgcgtcactgctttaaaaatatactgccacttgcttctggcctccaggaatttttaatgagaaatttgcaggtgctctttctaaggatctgttgtgtataataagttacttctgtcttgccatctttaaaattcaatctttgtttttgtctttcaaaattttattaaaatatgtcccagtatggatctctttgagtttatccttcctacacgtatctgagtttctcgaatgtgttgatttattttgattagtaaattttggaaatttgcagtcatttattcaaacattatttctgctgctttctctttctccttcccttttggattttttattatgcatatattgttatgtttcatggtgccccatgtgtttcttaagctctgtttatttttttcccttctttttcccttcatactgaatatttttcttcatactggatattttcaactttcttaattttaggtttgttgattctttcttctacctgctttaaccaacttttgaaaccttctcatgagtttatagcatcagttattgtactttttatcttcagtatttgtatttttttataacttctatatctgtagtgacattttctgcttgttcagatgccattctcctggtttcctagacctttttgtctatggtttcctttagctatttgggtgtattttaaacagtaggtttaagtctttttctactaattcaaatgtccgtgctttttcagggagagtttttttttttttcatttcttttgtgagtgggtcatattttctttttgttaatgttttatgattttttgagaactggccatgtttactattatacattggtaactgtgcaaattaattttatttattcttcttgggaattgttttattgctgtagttattgaattaaatacttttaaaaacaatttttataaggtttatattcttttctatgtttgttctttgaagcctttgtccctttaactaatgtttaaacagcgttttgacagagatttccatgaatgccaagagtgcgtgagtgagaaagagagacagagagggaagggaatggacatgaataagaaagaaaggaaaagagaggcagaaaggaaatacaaaacaaaaatgaaaatcctctctcagtctgccagttgaccctttgtgtgctgggccctccttcaacacttcgccaggctttttacaactctgccttagtttttccttcttgtttgcactgaaactactgctcaaccaggtgtgaaagtttgggaaaattgtgaggtcttttctgagagtgtattctgccctgggcatatgtgtgagtttctgagtttcccactatgcagggatgttttggatgcttttatatcccagagaaaatctgtgcctagcttttctgtgcagctttgggcactgtgttatttgcctccattgtgatcttttgcgtgtcctggtggctttgcgtgccctacggtggtttttgaggatcgtccatctcttgtgcctcatgtgagttctgaatcgggtgatgcaaagacaaacaccttttgtcagtgtttcaggccgcccccagatggattaggacagataagatgttgggggcccctgctgatttggtggtctctgcacattagtaaatgtggtttctctggggaagggttctcctttacaccgagaatccccgcaggacggtcctttctaggatcacgtctgccactgcctcctgcggcatttagtgtccccaaacactgttctggagtgagtgtcccattgttgctctggcaggtaactgggcagttgtattcggtgatgatagactatctcagagaactttgaaactaaaattagtcaccacctttgttggtttgaaccatagtaaattcaactaattttctattcacaacaatcgtatttgcaagttgaatatggcatcagatttgaacaaacccaaagttgtcagaatccctgcaagatggatttttttatgaaatggtccgtaaatgttcttatcagcaaaggttaagtgctttaagctttacgtggataatataatgatacattagtccttcaaagtgtccccactttactgagattaaaatctgaatatcatggcaactttgcacaaccatgcctggtctgaccttctctaccctgaaggttgcctctcagatgtcttttcctcctgcttttcttcactaggctcactggcttcttctactgccccctgaaagtctggctcctaacctaaggcttttccacagccatattcccttcctggaatagtccttcctcagtgttcttatggggttttccctcattccctttaatccttgcttcacatcacctctcattgacacacacgatacactttgcccccataagactagcattgtctttcccattactgtgccctacattttcttctcttccataacactactcatctcccaacagagcatgcagtttatgtattgagtaggtttattttttattgtccaaccctctgcactaacatggaactccagggagcacagatctgtgtcttctctgagcctaacacagtgtccacacagttgacagtcaatcaatatttgatgaataatgaaacatgcttttcttttctttctcagtaagtgaattagctgaattctaatccacattttgttgttggaggtctttgagtaattgatttgatattatatcaacgtaaattatactattagtgtgagtagctgttgggcatttcttatgaacatcatttttctggttaacacctcttcgtgtcctagttaccttttccattatattgacttttcatctaaatgattaaggtgattacatgctatgttcttctatagcaagtaccataaagttacttacacagaagttttttgaaaaataagtaattcaactgtttatttcctcttaaaatgtcagtggaagtaaatattacaatttgagatcctcttaaattctgatcatcatagattttactttatttccaaaaaataagccagaatccatgtctgtaacttcacatttccattttatacctaaaattgtttttgtttaacatttacttcctatcacttagttttgtttggtctcctggaagccactttcaaaccttcagcaggtcgattgcaaccagtggccattgaggaactaggatcagccaggcagccaggatagcagcatggcagtgaccccagggggagggttctattcaattttagcaaccaaggtaagatttgcaggtagaaggaaacgaagttcatgaaaaaggtaattatctgtatttaaggaataacattttggtaaagtcaaaagaatcaaaactgtcttagtaagacaaaacccttgaaattagtaatataggtaaattaataggtctcctttgatggacaaatgatttacaaagatttaagctttttttttttttggaggtacatctgtatcaaatgcttggcctcattttcaaacaatggttagttatttgttgtcttttaaaaaatactaacttttgttttagatttgggggatacctgtgcaggtttgttacatgggtatattgtataatgtataataggtagtttttcaaccctttgcccctttccaaataaatcattatttgttgtctttaaaatagagttccattttcaccagtgaaagatgactttccaaagttgtctgcctgtgtacacagaagggacccaaaaaataaagttttcttctctgtctgaattatgaatgcattgagaaataagacacctcttccacaggtgtgagaccactggaaagcacccaacaaatccaaaacttattacaatctaagctgacttcaaccattttagttgatatctatagccatatgaacttcctaatataaaactctggattagaccaacatccctccattcctccccctctaaactccactgtgcctctcagcaaacgtaagaagtatatgcattgcctggtacttcgtttccagggtggagagagaaaggcttcatgctccaagttcctactttccttttccaaactcaccaagcaaagaatttgctctacttccccagaatagagagcatcagaggggtggagacccagcaggggaattatactgctggagttgttacgtctgcatagaaagcaatacatccctgaaccatttatatcctttccatataagtctatattcatttgagatttgcctgaactgttgttcaaattgaattcctgagacatattttagacatattgagattactagatccagactactccagaagagtaggtcaaagatgaaacaacagaaaaggcaattgagaaatagaaattgcagcaaatacatggagtgtaacatcggccctggtttgcaccgggaaagaaaaaagttgctgaggcattatggggctttgagaagttattatttaacttggacatctgaagtcaattcaggtttacaaccaacctttatatttgaatggaacctaatcatgagtaaatgaaaccaatccaatcctaaaatatcctctgtgatattatactttggttaaaaaaaaatgactactgagactactgagatattttgcatgaataacgttatgaaaaatgcatgtcttcttcagaatcctaaaagcatggcacttgataaagattagttatttgcaaatgcctcccttcaaattcaaaataatatctactacactttggagtttcaaccaaatgtgtttgaatacaattttcctccaacatttccttttctgccatttgtgttatgcttattttcagcctggggcaacttaactcctggggatcacaatgagatcaggaacccgctgcagttgactctctgtcactggtggttatctgggactattttaatgcatgtcataaatcacaaaactttccattttgaaacaagtagaaatgatattgagcatgggttgctaaaatctattttagaaagtctggtgtctgtaagtctttcctttatttgaaatgcaaattttagcctggaaaggaaaataacatgacagacaaggtactcttgtgaattaaacaattaccagaatttttagtaataacaaaaaaatgtttctactgcagcacggaaagatagccatgacctacttgagtctacttaaacttctaatgtggttgcgcctagtgatcgtcaccttaattcagttacttgggagtctgtggatccaatcactcctttataggagcccgatttgtatagatgaaaagtcatttgctttatctctaaaattgcctcctgctgtgaccagtcagatcactcaacacctaagagtctactttggaaatttctactaaatgggctgaatctgtggctgggaaagagacaaggagctctgtctctcataaacacatcctctagagcggggtccccaagccctggactgaggacaggtacctatctgtggcctgttaggaaccggaccacacagtaggggatgagcagtgggtgagcaagggaagctttgcttgtatttccagccactccctatcactcacattaccacctgaactccaccccaccacatcagcagcggcgttagattcttacaggagcatgaaccctattgtgaacggtgcacgcaagggatctagtttgtgcagtctttatgagaatctaatgccccaaaaccatccccacacccttcacagaaaaattgtcttccacaaaaccgccctggtgccaaaaagcctggagactgctgctctagagcttgtcactgcgcttgggattgccctgatggctgaagctgtggcgaatctgtctttttttttaaattttgagacagagtctctctctgtctccaggctgtggtgcaatggcttgatctcggcccactgcaacctctgcctcccgggttcaagcgattctcctgcctcaacctgctgagtagctgggatcacaggtgcagccaccacatggggcgaatctgtctcggcaggctcggcacagtggttctttctggtaggctgcatgcactgaccccgcttgtctctttaaatggaaattcccacttcctcccaaagcagaatgaaacagacaaaaaaacagaatggaagtctcatatgtttgtttcaaaagaccttcactgatgctaatacattagactaatgagaaatgtcaaatgtctcttcacagttattcctggtctcgaagtataaatgagactggatttctattctgacatcattttccccaatcccatcctttgatttttatggttcttttgaagactcctatttaatgcaatccctcaatgctttataattgggaatagaatttattgctgcttcctctgcctctcctaatctcctttattattaatttaattggaaaaaaattgtgttaaagatttgacaattcaagttcttcctgactcaatcatggctcataggtatcttagaggaaagctgagacttagacatttttctaattgagtctcctttcattatacttagggagctagacccagaggattgagttaaagttctccctatcaggtctctaaatcatactagcacatgaaagataatctaatgtctctccctaacttgcaggccagggttctttataagacaggagtcctttaattccaatgagctctctgtttggttcagtaaatcaaattaggtcacccctaataatcacacagcttgcccattaaatacagatggggagtaggtatgtgtgtttaaatctaaagacgtgtgaattagagtgtcatgttgaaataataatgacagaatatcatcatatacctggcagaaattgaaagagaattatcccagaagatgtgtaaggatcttatgagaatattaaccatgtgggcctcattttacagctggatattaaggaatagttttgttcttaagtaaaatagtaaattatgactctgattagagaaaccagtaaactttattttttcttctgtgatccgcttgtgtttgttcaattcctccccccaccagtatatgactataatcaagctacagtgcaaaaaattagaaatgatgccagctgaagacccgagaaacagcacagcagtggaggaatgcactgcttgagctgatctgcttgaatattcaacgctattaaaggttgattttgtcaacacttttttttctggaaataccaaatctttaacatttgatcattaaacaaatgctttttatgatttataaaactgtcctcttgctgtttgccaggtatttaatattcttaagtttatacacatctgatattagggaatttggtacaataatttgattttttttctcagttgaaactatagtactcattttagcctcagctttttgctgccattcgcttggcatcatgttatatttcctgagacatctgcactagatctaaaagttttgatcctttgtactgctttgatcagtgaatattgcaaatggtcccttgtctctaagtccatatttcttcttgttatcaatatttaacttatgagtacaagtttctggttcatttgtaatggttaaagcaaggcaaataagaatagtattatcctgctaaatagatcaacacttctgttcacatactttatctaggcaactagctatttttctgctttctactctacaaccttggaagcaaaacttgggtaaaataaagaagaatagaatctagatgaaactgaataaccatgcttaaataggcaaaatacatattttctgctctcaaatctctaattagaaatcagtaaaataaaatcacacacagaatcaactacaagctgtatcttttttttttttaactcaaggccacagactcgaaaggctgtcacttcctttttgccaaaatactttgtatagcaaatccgaattctccgtggagtttcaatgtcatgcgttgtttctgcagaagcatcacgtcgcaaaaccaagctaaaataagaggcagaagccagggctttgatttcttgcccacagcttaggagcaagttaaaagttgaaaggccatacaaatggatgtagaaatttagctgaagatcaattacagtggcaaatccgttaagggagctattgttttcattgattttttttttttttttttttttttttcttgagacggagtctcgtactgctgcccaggctggagtgcagtggcaccatctaggctcactgcaagctccgcctcccgggttcacgccattctcctgcctcagcctcccgagtagctgggactacaggcgcccgccaccacacccggctaattttttggatttttattagagacggggtttcaccgtgttagccaggatggtctcgatctcctgacctcgtgatccgcccgcctcggcctcccaaagtgctggtcattgatatttttatgactatttggtgtcttctacatattcacacgtaaagctgtctcatcccagacatgataaattctaatatcaatcaagttctcgacagtcttatgttcaaggcagctgtgtcatctgtgtgaacgacactctgtggagttgtgcagtgcacaacctgtgcatcaacacatggtgcccccagtcatacacctgcaaatattattgaaattccaaacctcttttatttgttaaaggcataactcatattgtagtatcaggtcagaatagttacttatgaaataaaactaaagataaacatcattattagtttctgaaatgcctacacaaatagagacaaagaaacagaatttagccttcggctcagatacacaaaaacgtttaattttttttccaattaatgtagtttcatggcttcttataaagaggagtagaagagttcttaaaattaaaaaattggcctttgcttttgtagtggaatttgtagacacattcttttcagaaaatgacagaaaaaatactatatcatttctaaattgtgtcaggataggatgagcacaggggtagaagtcctactcacgtgggtttatacccctcatttctttgctttgtatatgtggctttggaaaaaatcactcaagctctttagtttttctcatcagtaaaataggaatgataatgcctgtctttcaagatcatttgtgatgattaaaatatggaaactatttaccttataataggtactctgtcaatgttcacaatcattactgtaggtagtaataatatcttttatcagatacaatagtcactccagctcccttgcttccatagaccaaatgtttactgtgcactgggcactgtgcttggcacttggaatatagcagtcagtagattataataaaggtatctgccttcatggctgccagtctagagcattactatcttcttgagaaggttagatcatataatgacaggtgtatcaatgatgactcacttattttgagcaccttggcaaatataccaactgaagcctacaagaagagtttctcggccaaagagaatatataaccgcagtatagatatgtttattgaaggcactactccagggccctaggatactaggtgtcagtactaaggaagtgctggcttcattgcagactgaaattgatttacgtatatgcggaagcacactcttatcctttgtgacgttgttactgtggtgggtgtgcatacttcccgaccaactataaacacacattttaccagacaagtggtggggtggcatcagccggcatctgatgtctcaactccaacataatggagtagccctcatccccacaaattctcttcctaaattcacaaagacactgaggaaaagcacaactgtaaatgttaaaaatccagtaaaaggtgaaacatggttgtctgtgaaatgagcaacgtaaatggtgatatgcatcatgattttatccatgcagccactgtgcaaaaaaaaatcacattttttgtgcagatagacactaaacccaaatataagttatagcactatttccctaagagagggagaaagcaggcatgtgtgtgtgtgtttgtgtgcatgcatgcatggtgtgtgtgtgaggaagatctatttcatgcccttgtggtgtggactgagccccaagactcatggctgaggcaccattaggggccacttggtgacagacaatcccgtagatcacagagaatgtggatcatgtcattatatcctaagtgactcacaggtggggaagcaggaacaagataaacaaaaaactacaagaaattagcaagaaaaaacaaccccatcaaaaagtgggcaaaggatatgaacagacacttctcaaaagaagacatttatgtgtccaacaaacataagaaagaaagctcaacatcactgataatcagagaaacgcaaatcaaaaccacagtgagatgccatctcatgccagtcagaatggcaattattaaaaagtaaggaaacaacagatgcttgtgagactgtggagaaatagaaacacttttccactgttggtgggaatggaaattagttcaacaactgaggaagacagtgtggcagttcctcaaggatctagaaccagaaataccatttgaccagcaatcccattactgggtatatacccaaaggaatataaatcgttctactataaagacacatgcacatgtatgtctactgcagtactatttacaatagcaaagacttggaaccaacccaaacgcccatcagtgatagactggaaaaaagaaaatccagtacatacacaccatggaatactatgcagccataagaaaggaatgagatcatgtcctttgcagggacatggatgaagctggaagcttcatcctcagcaaaccaacacaagaacagaaaaccaaacaccacatattctaactcacaagtgggagctgaacaatgagaacacatagatacagagaggggaacaacacacaccaggacatattggggggtgggggatgaggggagggaacttagaggaggggtcaataggtgcagcaaacaaccatggcacacgcgtacctacgtaacaaaccaccatggcacacgcgtacctacgtagcaggccgccgtggcacacgcatacctacgtagcaggccgccgtggcacacgcgtacctacctaacagacctccgtggcacacgcgtacctacgtagcaggccgccgtggcacacgcgtacctacgtagcaggccgccgtggcacatgtatacctatgtaacaaacctgcagtttgtgcacatgtatcccggatttttttttttagaagaaattaaaaaaaaaaaaaaatagaaacagcaaactggcgcccgaaacactctgaagttacgtatggcccagtggcctatttgtccaaagagatggatatgaacccatttgtgatttttatacatttaaatttgacttgttggagatcaatttcttcatattaaacttataaaacaccccttaagaactgactttgctgccatcttggcctcactttggatggcctagaggagggccgtgtcagcaccttggctgttagtctatgactaggtccacatcccgggagagagaaaatgtgttggacatttatatctctttttaaaaatgtgtgtactaattttgatgaggttaaaaaaatctgctcataatttgtcatgattcaggtctccatatctgtataattttcataacaaaaaaccctcattatattcttctttactgtctgtcctcttagagagcttgtattagcttcaaccttcaggtataatcatagatctaggggttttagtatgactttttaacatttcaatttctctttggaggtgaactctactaagcattaaaatagagcatggtattacaattttaaaatatgccttgttgacgcagaaatctttcttcattgttgaggaaagacaactatggcactcatatatctacacagaaagaatttgtatatgcgaacacccaggaatcaggcaactggtagttttacaccttttttagtgagtaatgctgaatccatcctatagtatcccaattaaactacatcaatttacatctcagagtttaaatgcactacttagggaaacattttactacattcattcactgccacaaccttgagacactggagcttctggcttcacccgtattaaagcaagagtaatacatagcatgatttcaaatgtagggaacaactcaatcctactgacccaagatgaagtgtcatcactgggaatttcattaagagataaataaatacctgacatacaactaattattagttctaagaaaaaataaatataataaaaagattagttctaccatgcatagaggaagagaattctctccactggcaatgggtgctatgtttctataagaaaagtagcattgacttcagaataacttgcattattgaaatataagctcgaagtctctgaagcgaagactcaggtttagattgtcacctgtttcaggcaaaaaaatcgtttatttccaaaacatcgatgtgagatctgggaatcgtgaataaaacagtgcttgttgtttttgatttgattggctgaggaatataaccgactttatcactcagaatctctaaagtcgtgttacatggccttgaaatcctcatattttaagtacaatgtttaagtacagtgagcggaggagcacatgcaggcgtggggtgccatgaagcctccctgtgaagaatgatgtgtcccggaatctaaaggacaacagggtaaaggcaggcacagggcaaatcccactcatcatctttcacgtaaaattctcttgcaattaggaggccctctagctaaatattcctttgtaaaaatgacaataatcatcttttttcttttctgtgtctacccctgcttcctaccttcgacatctctttttgccagtctacaattactttgcaaaatgggcagcctcgtcatcccgcacctgtggaaactggggctcatatccatgaggcaatatgttcaaggcttaatgctccatgcagcaaattaatcatattttagatttgtttgatccgaagcccagtgctttgcttgcctttttttttttttttttttttttgcccctgcactacacctgctgtcttggcaatttgtcttttcagagtgggtacacactgaatgactttattaccattaatgcaacaatttctcagtaggtgaaaacattacattgctggagttaactaaagctgcctcccctgggggcaacagcagagggaacaacattgacatcatatccgtgaggttccagttctgactcatggcagccttgtcttgcccggaatgatgacccctgtctagaaggaaaaagcagagatgccaacgtccataggaacagcatgtaggagaaaaattagcttcccataaagcagggagtatttaaggagctttcgacaatcaggctgctgaacagggttgagagaatagcaactctgcttttggaattaaaatatcacctgcatcctaatgttttaagtaatcactaaccagaatatagatttatagttctttcaagtaccactgctttccctgcttccctatgagtgtgcacagagatttaatttgtccgaccacctctacctcccacacatgcactcaaactcacccacaggcttcaacaattgaatgtcaactagcaggcactattctagaaatgggcatataaacaagccaatcattatcttcactcttggaaggtttacattttagtgtagaaagagatcatcaatgcgtaagcaagtaaataggatatttcacaaagttataaatgctataagggaatacaatagtgtaggcgccaggcatggtggctcacacctgtaattccagtactttgggaggctgaggcgaggccatcacctgaggtcagaggttcctgcccagcctgggcaacacggtgaacaaccctgtctctactaaaaatagaaatattagtcaggtgtggtggcgcgtgcctgtaatcccagctactctggaggttgaggcgggaggatcacttgaacctgggaggtggaggctgcagtgagctaagatagcgccgctgcactctagcctggtgacagagagagactctgtctcaaaaaaaaatagggcaaagggtagcatgtaatgttggaagaatgttgctgattgagatatgagtgtctggaaagagtatactgcattgagtgagacctgcatgaggcctcaatgaaaaaatctgggcaaagctcatttcgggtagctggacccacatgttcaaagggcctggggtgggaacaagcgtggtgtgttcaaggaagggaaagaagtgacactgaccagtgaaaacctcccttttccttttggagtgatacaaaccgggtactcctggttcattttgagtgtaagagctcccttcaaggccttgctcatgggcaaagactccacagtgagaaatcgattccttggctctctttcaggcaggctgcctctggcatttttacttttcttctttgctcatgtagtgagtaatctcccataagtgtttgggagtaaaacccaaccaagtaccctagggcgctgagccagagtggctgatgtcagtagctccaggtgatctgagaatcatcaggctttcaaagcctcctacagggcatggtgttcctgcaaaatgcctgaagactttaattctgaaaacccttaatcgaagtccccggaacggcactttaaatcatggtccttccacaattaattattttccccataatgcagaccctggaataacccctgaaactgtagaagataatgcagaatttaatgcatatttgatttgtttaccgtttcaaacagcgcttatctgatcagggaaacttccacttccttcattgaaatctgaggcctctcactatttcaaattccagagccacttagaagtctgtcgtactccttagctcttaaataaaaaaattcactgaaaatcgcaatggaccattttattttatattattttattttttctttattttatgttttttacttgagagttgcttgatagctacgtccagtaggagtaaggcaatgtttagtgttccagaaaagccaacaggtatacaatagaaattgactacaaaaatgtcaaaaatgaaagatgctttggaggtcaaaaatctgcctgtcagaaagtaatcaagttctcgtttacacagtaatttatatagacatgaaaaccataaattgtcattttcacaaaatagatgtagtaaaaggatcgacactgcccctgagtgtaataaatatgtaaggtttatttttccaccaatgatgttgttttagaaaggagccagtgtggtgatctgggctttttgcaaacgggataaaaaccacaaaggctgtttttgatgtttatctccaatgagacatactgttcagatgataatatggcttctgcctggactctatttacacacaaatctatatacgctttcaaatgatatcaggccccagagttggagacaattatacattcccaagtcttttcatctccagactgttcctctgcagtcctgtccatcatttctcaaatgactcgtttcctcgtttgtagaatttgctacagagtatcatttccctgcatggctgtctccacatacagaacagtatagtccacatctttctaagtccctaaacccaattacatgtcaaaatatctttgatgtccaaacatttgctctcagacagaggttttgaatagcaaaaccattccctcatcataaagcattacccaagtaattattttcacagctagcaaagcaaaggctaagctacacaccccacttcaaaggctgtgcacgaattaaatgaggtagtagaacatatttggcacaccagtttttaaatattatgtccacctctactactttctgagaatgcccacccagcccaggactgagagaaacagcacagtttcatccaggtgtagaatctaggaaggcgtttgtttatgataccttcactcctcaaatgctcacagtgaatcagtttggatcacagatgaatcatctcagctgctactttctaggaaaagtatgtgccactgctatacagcagcacgaattacagagcaacagcccgggagaggagccaaccaactgtaggggggtgttcagagtggaggggttagttcatctcagaaatgatgagggcacagggccattttctaagctgggtgtttctgagacaggctttcaaagtagaaaattgtcataggacacagtgagccctgcctttactggaatgtgttttccggcctccaagaggggcactgctgtataaccaaccatcaactccatggctcaccggggccccgaacaagtagtcctataggctccttgccgagcacttgcccatcttgcagacctggaccttcacaggatagagagtagcacctacaggctgaccaggtcacctccaaagcaaggcacttcgtaggtcagttcttactggttcctgcaggactggcaagtatttaatccaaatccaaattgttcacatcttgcatgccaggtagtattgcaacattaactgtagattagaaaagtgttcagcaaaatgttagcaataattatctttggtaataagactatgagtgatgtttatgtttccaattgctacttaatactttcacttttttttccttcaatgggcattgattagttttaaagaacgacagaatttagagtccctacatatctagattttccgaatgtctgtatttactcaccattttattttgtgatctaaggtatttattgtgatatatgttatgactcgatcaccatacatgaggtctgtaatgcactgggttgcctgctgtgtttgttcgtggagatataactgggtttggtgggacggctctaggctttggtgtcagaagaccttgattcattcccagaagactttggacaacttacttcattttcacttgttcttccatccttgtaaaaatcatgatgtgtggctacttagacggtcaacaaagagtatatgtgaaaatgtagtttgaaaacagaacctcagtccaacagtataagacagaatttaaaaatgactgaagttaactctgtgtatggaaggttgtggtattaaggacttatctaaggagtagaaatctgcaaaaaaactaactctctgattcttctatatctaacattctgctgattactttagataggagccagatgtttcgtatattattatttcggtaacagatgatttagattccagttgcctaaaattatggcatgtgttcaggttttctcttggaagtttgtttgaattatagcagcaaaaacatctgtatgcacaatgttgcatgtatgtttctctgtgatgtgtattttggtatccatgcaattacagatgtgtattttggtatatgtgtaattgcatgcataccaaaatacacatcacagagtgtgttcatatatatatatatgaaattgaaatcgaaattgaaattgaaatcaaacttcagtatcactaggaaaaatatacacatacatatatatatacttcttttttaccattgatattgccattgatattgatattttatttcagggtgacttccggtgtcagtttatggaggaagaagaccattagacttttttttttttttttttagcaataattaaggtttcaatccctgtaaaataacatcttaattttaactaaaacattacaattatcacagaaactaccgattattttattgccctgaagaaatacaaattacaaaggtacttacaagggattcatgttaaacaacatgttgaaatatggttatgtttgcagcatttaaaagttgtccattaagaatattcaattaaaataatccacttgtttgaagctgtacttaaggacatcatttacattaagcttagatgtacatcgtttacaaagaaaacatgtatagaatatttgtgcatactctatagtaggcaagggcccattagagtataagatccaagagaaaagaggactaccatattagctttaaatctagattctatatctttgtggattttatggctttctattctgttccactggctatttaggcttacaccaatcaaacactgctttaatcacggtggctttataataagatgcagtattaagttgcagaccaaatacatccgattctatcttaggcatagatactttaaaaacttcttggttgtttgcactggacagccaacgatgatattcattctgctaagaacttttgagcagttgccaaaatttctaaccggtgctatggaatgtcaatgaatggatcaaatgtgactcattcagcaacatgcactgtactcattagtaccctgaatgcagcctaaatgttattccttgaggaaatcttcatatctgttcatctgattcaacctgatgggtctataacagtaactactttccagttgacgtttttctgttgaactgatttttcttttttccaatttataatcaagtcttccctttttttgatttactgttaagcaagaattactcgtaaagcagacaagctattttctttaaaaacctttcaaaaccccacagctttaatatttacttgttacagtgttattattggacttaaatttagtggaaaatgggctttttattagttctctggttttaaactcataaatccctttcattaaatctttttattaagattttgccaactcccacaagcatttgataatattactgtgaatgatttgagctcactgaggtctactgttgtaaaatactttttaagtataaaatgtagttgaaaataattttctatttgtactttaacaataagagctgagataatacttgtattcaagtacttacactacatgccacaatctgagtacacccaggtcccttcaaaactttctcaatatttttagtgtcaaaacatttaaatacatttaaagcacattagtgggaaatgggcatattaagaaggtaagaaacatagacagtttttgcgagctacttaacagctaacctcagacaaacgaaatgttggaagggtttgagtgggttatcctattcccttacaggatagtaatatttacagggtacatgagcagagtgtgtttatgagagcacacttccaacgatctgtctgccccgttttcagctttggctcctcttgcttcagttggattggcccaggcatggccatcagaggcagactgttacaggtaactgaacagaccaaaaaaaaaaaaaaaaaattgacaaccacagggaccaaattagcatggcacggagagcttgtatgtgggaagtaacttgggaaggggaagggctgaaacaggcaagtagggaatcaccctgcaaagtaggtggatgaagatcaggagtagcggaaatgaaatgcatcggtgaggctgacaaggcaggcatttcagtttgtctagtggtaaaaatagaataggtgggtcaggtgtgcagctgttactaatctcccagagctgttctttcagcgcttggttcttgcaggaagcctggggcctacaatttactcaagggttctattctttcaaactactccagcagtctgggagtcacctgagaagtgctttgttagaatcaataacacaaaatcttcagaggcagaggcagaatgaaatcagttcctcagacactgctcagtggcttcaaggtggctttgtggcactcaattgcccttcagccctcatcatttcccattgtcatgtcaatcctaaaccctcagggtgatcccaattccacctgccaaagggaagttcttaagggagggctgagtaaaacgtgagatgtcctgctgtcctgcttagggactaagctaattcacttactgcttacttactgctctttggaactctgagccttttctttacttggtcccctcattttgtggtacaccttcctttctgctccacctcctaagtcctgcctgtgtgaacgggtagacatcaatagtgaggatgttgttacagtcctcgttttgctgagctgctctttcattttagcgtcatttaacttaccttgttttatgtcttttattttcaacttgataagcttcctttatgcatatgttattcttctgcccagtaagacatttgccagcacaggcaccgatcaatcactggcgtattgaccttgtttttttctaactattcttattaccacatattgcagttatgtggctaggtgtgtatgtatatagttttataatgtttattcttctgtaacttagtttccaccaacaaagaatttagggtggagtgttttaagcatgatactatgtagatagcaccaaatttgttcccccatgaactgaaatttgatattgatgaggctgtattttaaagtgacaggataaagaacttccctaaacttctaatattagttacaaaatgttgcatattttcttttaatttgttgttgtcctctatctttcagcactgcagaacacttaatttatccttcaatatttgtgcaagaattataaaatgttgtaaaaattggctaggccgggcgcggtggctcacgcctgtaatcccagcactttgggaggccggggcgggtggatcatgaggtcaggagatcgagaccatcctggctaacaaggtgaaaccccgtctctactaaaaatacaaaaaattagccgggcgcggtggcgggcgcctgtagtcccacctactcgggaggctgaggcaggagaatggcgtgaacccgggaagcggagcttgcagtgagctgagatcgcgccactgcagtccgcagtccggcctgggcgacagagcgagactccgtctcaaaaaaaaaaaaaaaaaaaaaaaaaaaaaaaaaaaaattggctaaagtgtttagaaattttttaaatcacagattaaagatggccagaataatatgcttttttgtgtgtgttttctcttccaggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgaggtaaggtatcaactttttatattacagttagcactgtttgaatacacagattatgaaatctagttggaatatttaaattttattattgtgtccggagttggttccttccggtgggttcgtggcctcgctgacttcaagaatgaagccacagacctttggggtgagttttccagctcttaaagatggcagggaaacaaagagttagtggtagcaaggtttattgctaagagcgaataaagtttccacagcacagcaagggagaccaacccgttgggctgcttttgtgcccttatttgtcccctcccatgttccatttctgtcctataggaatgcccttttttcagtcctccgtgtgattggctacttttacgatcctgctgattggtgtgttttatagagcgctgattggtgcattttacagagcgctgattggtgtgttttacagagtgctgattggtgcattttacaatcctcttgtaagacagaaaagttctccaagtccccactcaatgcaagaagtccagctggcttcacccctcattaccagaaaagaaaaatacagttactatacagaaaacttgaagtctatcaacttgtggcaaattgtgcatactttttctatacttaaaaatttaactttttattgaaagttatcactgactttgtttatagatatattgttcaagatctgtgaaacagagttgtcaaggtaatttaaataaaattataatacaccattgtttttaagcaactgtgagtttgagagaaaaagaacaaagataaattcttgagtacaattcagctaatcagaacaaaatgaacccttatgttgtcagagaatatattcagtgaaaggaacataggaggtgggtgagggaacaacattcagggctattgcattctttggagaatttgtggtttagacaataatggtacaatctattcgtaatttgttttctcttttgatctatagtttttacaatgaagaaagcaaaacatttcctggtatcatttttaaattatattttttcaattgtcaacaagaaaaaattatacctgtacgtctgtatctactttttgttttcaatttggcaaaggaagaaggaatatcccttccaaagaaatcagattttcctaacaaaattaacttatatagattactgatgttaatgccaacagtaatacacacaagaatcatatgcttcatttattattttatgggatgagaaaaaaatctctacagaaaacacaattttatgtgtacatctagtttataatatgtcaatatatgctacataactaataggttaaatataaaatatattcattaatatattttcaaatatattttatttgcattttttcacccactttcaaacacctagttttttttctgagtcatctacaatatctattatctgtttttagtagcatgtttacctttcatacatagtagaatggccgtctcttttctgaaacaggtaagctttcctctgtccttttattacatttatggtcttatgtgttagtatttgaacaaagtatctacatatacaatacttgctaatttgatgtaggctttcttaaataatttatgctctttaaaagccagttactttttttgttgtcaattatcaacgctactagggtatagtagtgtattataatggtaataaaaactgcagagttacagaaaaaagaattagacaatccattttattcaaatgccaatgtgtgtgactctacgttaaaattatgactttacctttccattaaaaaatgcttgttaaaaatatgctctcttaaaaatgtttccattttctttctctcaatatttttatttactctagttctttcatatatagaaaacctgtcttaatttgactgacaggtatgtctttcaataatgtattatctcttatggtcttatggtactattatgatcattttatattaataaatataaaacaacattcttaccatcttcaatattataacaggatcgacagcggaaatattaagttagaacaattagaaacatatttcattttggagtttgagtgaacagtaaataaattgatacctgtgcctcagagagctttattgtgagttgtatgtacaacagaatgtttttttcttttacttgctgggttatgtttagtacaggaagcaagggaggttgataagaaagagcctacttaggttcatatgaatcactcagttaccgacaattttttgtttgaaatagagaaaaatatgtcatatttctacttgtttattgtccttagagttaggatgttgctttcatcttgatattccattttatatttcttcctcctatccgcatacgtagaatgccattttgaggagacgttcgaggagtgcagagtgatttctttgggaaccgtttagagtactgtaatacaaatcggaaaaacgcccaatgactactgagtgttacaggtctctactattacaaaaggtgaaataaatagagatgtgaaattggaatgggtgtgttgtcagggaaaacacatgaggaggtgttttctctttcaacattcaggatgagttgatggggaaagtagttataaatagtagcaaattctaattaatcgggaaagggagcactctaatgctattcgtttcccattatgccttgaaacagttgtttatttctcaaacgcaattaagtagcaacccttaaggcagctctagaattcaaaggacggattcttttgtgggaggattgatgtaggagctgctgataactgagatgtcacaaaagttattgcttagagctgtcttggtgtgttgttgttttattgttgcacaaaagctatttttagaagtttaaaatgtgcattaactgaaataccaaaacagtttttctgttaaacaacttgagcatttttagtatcaataaatttctttcacataaccactgtaatattttttttcgaaataaacttaagaggcagatttaatccccagctgacaaaacagaatatatactttagaattattgatgcttaccttgtaactggaactttagtcagaaatatagtattatttacatatgtaaaaacatttagagttaaaaaattaatatatcctttatattatcatcttggattatttctttagtacaaacacaccaacaatacatatatgatttgggcacccatcaataaactaaattttaatgatgtggatattgagagctgaaatgagacctctcttggtaagcacagggaagaaatttggactcaaaattcaaaatgaaaaatctgatctttgtgttatttagaattaaagcatctcttcattgttttttttttttttaatgacctgtcaggtggttgctgttttaaacagctgaactttattgactctgcatttcctcttgcttcccagtctccagtaaggtccaaccatgcagtcaccaaatcccaaaatgcttattttttaacatgtcttgggctaagcatggtggctcatgcctgtaatcccagcaatttgggaggctaaggcgggtggatcacctgaggtcaggagtttgagaccatccttggccaatatgatgaaaccccgtctccactaaaagtacaaaaaaaattagctggacatggtggcaggcatctgtaagtccagctactcgggaggctgaggcaggagaatcacttgaacctgggaaatggaggttgcagtgagtgcagatcatgccactgcactccagcctgggtgacagaggtagacttcatctcaaacaaaacaaaagaaaaaggaagtaggcctggcatggcggctcttacctgtaatcccagcactttgggaggccgaggcagttggatcacgaggtcagtagatcgagaccatcctggctaacacggtgaaaccccatctctactaaaaatacaaaaaaaaattagctgggcgtggtggtgggcgcctgtagtcccagctactagggagggtgaggcaggagactggtgtgaactggggaggcggagctttcagtgagccgagatcgcaccactgcactccagcctgggggacagactgaaactccatcaaaaaaaaacaaagaaacaaacgaacacataaaaaaacacctttccattaaccacagcctgtttttgatcctaatagtaaatgttcctacgaaggctcctgtcctggcacaggctgtcctgagcgttcacatagaccaatgcacgatcctttcctgccccaggctcccctctcgggaacactgacacatctgctgctgtcctagccctggcttctatctccggcaacataaacagttctagtacccatgaccctgaaattcaagaaagtccatgatcggactccaaactgcattctgtccttcagtccctcccgtttgtcccctgaaaagtatccttgttcagttgcacagatctgtgggttactccttgacctgaccttacaagagaatgttgtcctcttattcccggcctctccctctaccggtctgaatagtatgcgtctttcaaaacgcagtgcacattatatttatttcaggaaatcttccctaggcattccaaacaacaacccacgtacattttctttgtgtgcatgaactcctgtaacactggccacctactgcaattggaagcctgtactcctttgaactcacacctgccctgaagttacctcgcaatggggctcggggcttgtatatctttgtacattcagatgtctaatagaacataatcctctgaggctaagaaatgtgccctgaatgtgtcttctcctgtgattaccaacgtcttgagtttttccctgctccccctacccccatgatggagttttgctcttgtcacccaggctggagtgcaatggtactatattggctcactgcaatctcctcctctccggtttaagcaattctgctgtctcagcctcctgagtaactgggattacagggtgcaccaccacacctggctaatttttttatttttagtagagacggggtttcaccatgttggccaggctggtctagaactcctgacctcaggtgatctgcccacctcggcctcccaaagtgctggaagatatgttgactttcacatcgtcaataagtgttcgtggggcaattttgaattacattattcctgattcagggcaactcatccctgccactgtgcacggaacccaacgtgacttaatgtaactctctcctaaatgaatgtgagtcaaccatcccatgtggtgactgataattggtacatgttttctaaatttgaagttttatttacttgtcccaaatcagaaacaattgacgttgacatctatttccaactgtgataaaattattatatcaaaggtctaagagaaactccttagaaagtcagaaagtgaataaaggcgaatctatgaagggagattttaccactcaatatagaaaatcaggatatattaattcatgattattgtaaaatacaaggcctagggaaatagctttggcatttatctcgagttcgtcggtctttctaactttaacaagattacccctaattttctgcaatgctgataatgaagaggttagaggtgaatgtgatagggccattaaaatcagaaaatcatgaataagtgttgttaaaatagaataggttttccagttttcttaaacagtaataatgcttttgaatgcattaaatatttttaaaaacagttttattgtggatagttaggttacacaccatgacaaaacctacctaacataaaatatatctggtgatatttagaacttatagacatatgagggctaaagaaagggtctcaattacattaggatcatattagactagagacctagcattgcctaaattctgcttttctgtctccatagttgctacaaggtcctaagggagccattcacagatcaatggactgattaaaaaaaaaaaaaaacaaaccaaggtatcattttattttattttattgtcttgagactgaatcttgccctgtctcccaggctggagcgtggtggcaggatctcagctcactgcaacctctgcctcccaggttccagcgattctcctgcctcagcctcccaagtagctgggactacaggcacatgccaccactcctggctaatttttgtattttttaatagagacagggtttcaccatattggccaggctggtctagaactcctgacctcgtgatccacccgcctcggcctcccaaagtgctgggattacaggtgtgagccaccgcacctggccttcattttatttttagcttggctagtgagtgatgtctggttaagattgataatcagagggtgaagccactgtcaaagcttttatagggacaccagcctcatatgaacaccacacatgttttgacttcttattgatggcactggggcagccgtgcagtcaggactgggacagtgaccagcaaatatgaccagcacagggtgagggaggatcccagaaccagggcctggatagttccagggaagtagcagtggaagagcttgtcacacagaggtgacttcttaactggagcacagatgacacatcacagaaacccatcaatgcttagaaacctggttcaacaggttattgtaccttagtgagggcaccagaggtggacagcagaggtgtttggtccactcagataaacctataatgttcccataattaggtgattttgtcactattctacctacagattttaggatgatgaaataaaatgtaattttcctcaatgtatctttcaaattgctcttgtcaacatatgctttaaattagtgacccctaggtaagctcaatcattactggttaagtttgagtatttttgtttttgttttttgtttgtttttcgtttttgttttgttttgtttttgagtatttgcagttgtctagagagaaggagaagaccaattaattcagagattcaagggtgagattgggctctcatcatggttatacctaattctctccttccctaagtgatattattatgcagccttagttgacaacaactgtgagagtgtgtgtgtgtgtgtgtgtgtgtgtgtgtgtgtgtgtgtatttgctgtgtgcttatttgttaagaaaaaggataaaatgactagtaattagaaattctgtgataaaataagaaaacatgtaagagagataataattatgtttgcaatactatgaggaagttttgacaggcatgtgaattcagacaactacctcctcatgctgtggtggtgtgttttgcggtagctaaaaacggatggttcacttccatatcttggctttttttaaaaagcagcaaaaccatactaatatgggcagagaagtattttaggcatttgtaaatacaggtgtgtggaaaagtattcaaatattgcggttggctagagagaaggagcttcctgggatattcctcttagaaagttaaagcctaaggaaaagcattcagatttacacaaagggaacagaagaacaagcagacagccacatagtttgcaacatgacactattattagcagacaaagatatcttcttgatttggtcatgaaaatctgaatgttgacactgttttatacaatagtaaatctagtctttgctgtttgtagcaaaataaatatgttagatcaccaatgtaaatattaatatggaaaataaaaatgataaatattgtctaagtgtctttctaggcaggacacgtaatttagaaatcacatataaaactgaatgaaaaattggacttcctaaaacttaacattcaaaaggcaaacgacaagttaaaatatttctaataagtatgaaagacaaagaattgtttctcttaatttgtaagatgcacttctagagctacaagaaaattttaaataatccttcaattgaaaagcaggtaaaatatacgtaaggagtccaaatacaatacatttgtgccagtaagtatattcgaaccaagttaaaacaatgcagtatgatagctcgccattctgaatgggcataccttcacattttagtaacagcgtttttgaggatattgaaaacatgttttcatgtctattggtaggatattaaattgctgcaacatttttgtatagatattttgaaatttttctcaaaataaagtacaaacttttcattcagaaattctagctaagaatgtattctacaaatatgcattcaaatatgacaaaataaatgtaaaggaatgctttttgtttcattttgataatgtttgaaaattcaaacatgtctaagtatataaatgtagactatcaataactctcactagttaagtaaattatattagctctacaatacaaattaccattaaaaacaatgacattttatttgcggatctgagaagatctctcacatatatgtttcatttaagaataaacacagtatcagagtgtccattttcttccaaggttttattctcttttaataaaaggcgtgtaaaaactcataataaaacaccatcaacgaatttctagatgatggtgggagctcagagattcctgatctagatataattttaacaggttgtagtgatttcagtagaggctgtgggaagctcctccaagggtatctaactcacctgagggctcttagatggcttcccatgagtcagtgtaattttaaccaaggtaaaaatactgccttcatccagaaacagtaggccattttagtgtccctggcagggcatgtgtgaggagagcattttttttaacattttctttttcctgtgtgtgttctctgtccttgaaattcttacactgaattacatctgtgtttatgcttatcctatgtctctttctctctctgtatagttttatgtgtgtgtatatactgatactgtgtgtatatatacatatacatatatatgtatatgtgtatatatgtgtatatgtgtatatatatgtatatatatgtgtatatatatgtgtatatatatgtgtgtatatatacacacacacatacatagaagtatatatatatgagtgaaaaattggacttcctaaaacttaatactcaaaaggcaaatgacaaattaagttaaaatatttacaagaggtatgaaagaccaagaattagtttccttcatttataagatgcacttttagaactacaagaaaatgttaacatagaactgcaagaaaaattttaaaaatcattcagttgaaatttgatactgtgtacatatatatatatatatacacacacacagaagtatatatatggtatataatatatgtgtatgtatatgcttctatcagcctttctccactgggggtgatttttttgtcccagggaacagtggcagtatctagagacatttttttttaattgtcacagtggggagatagttgctcttagaatctgacaggtataatctagagatgctgatcatcgtcctgcagtggacaggatatctcacatgacaaagaagtgtctgccatacagtatcagaaatgccaagggtgaaaacctttgatttatagcaatatctagaattgtctgtactattcctatactattcatatgtctgcctacattatttttctgttcaaggccgaagcttaaagaggttagctggaactggctgaggggagcaactgttatttttttggcggggcagaggcagccagcagaggctggggcatcccggagcagctggagtgaccaggaatgggaggtgatgttgggcatcgtgtcaggaaggaagtgagttttccacagtagtagacataatcaaatttcatgaagaaatcactttagtaattattttacattgtctttcaaaaggaaatgaaatagttattttatttaataccttctgagaaaagaaagtgtcaagaatcagtaaaattgttaatttacttctattcttttttcttcaggtatcaaatccacagaagtagtttgttgaaatagtttagtgggaaaccatccatattaatatgcaataaagagctataaatagtttcccagatttttcaggattttaaatgagctttatgtggatgatcaagtttgaagctgagtgacttttttctgtttaagatttactttttcttctttcccccatcctgcccatttcaagtgactggacagcaaagtctgttgctgatttatcctttcaacctctaagagtagctaaacattcagaataaacaagtgagttttcatcgcataatattagttgaaatattgaaatgtatagttgtttactgaataagttcaaagggaatgaatgctatatacaaaatatgtgagttattcacttttaattcccaaaatttaaaaaaggaatataatattacttagagtatgaagcaattacttgctttaccacaataaatacactcacctacttacgtatccctttgcagagaaatctgatgcactttgtttatatttgaatgtactaaaaataataaagaatcgaaaaggcaagtatttcacttgattttcttcttgcttatatcgttcttgcttatgtcttagaacctggagtattaactagaacagaattcagaactctgcacagggcttcaggttttcagatctaagtgaataaagccttcatatattttctttggggcatccttgaactgaagggtaggtcaggatggggagacgtctttgcaagaggtggagtgaagcccactgcagagctcttcctcagaatcaagctggcgccctgccctcccacaccctgccccctgcggtcctgaccctgactggatttccttggctccatgccctgagtctagctcttgttgatctccttcttacaaccgctttaagatcagataactttctctcaacgtgattttcagcacaacttcccaagctcaaatgttgcacccatctcacactaaaccctcaaacagaaggttcagagttactactattgttggactactacttccttccacatactttataaccaatatctgttactttttcctttagaaatcagtagcattaaaaaaaaaggtgtggctggctcccagcttcaaggcacagccccccgcaatgaacaggctgtatgttcaatttgagagaatcagagaggaagcagaaataacacaagggattgcttcatgcaggctgtgtcctctcagccaaaagaggaaaactgagctaaagaaaaccttggcctgctgaaaacttcctaaaatagctttgtaaaggagatagtgtctctgtttctcatggtctatacatgaatctttcatggcagtttttctccaattgtaatgtcagttcttacaagtccgtgatagtcccatcaaaaatatatcaaggttggccaagcatggtgactcatgcctataatcccagcactttgggagaccaaggcgggcagatcactagaggtcaggagttcgagaccagcctggccaacatggtgaaaccccgtctctaccaaaaatacaacaattagccaggcgtgggggtgtgtacctgtagtccctgctactcgggaggctcaggtatgagaatagcttgaacttgggaggcagagattggaatgagctgagatcataccacggcactccaacctgggcgacagaaccagactctttctcaaatatatatatacaccaagcctgtcttgaatatgttacggatacgataatcattatatttgcttgcttaggtttaggggttttcacatttttttttagattaaatatttctaaaatgtaaatgcacgggatatgttgtgactttgtatttgctcgtgtatacaggagagccaggggaggcagggaagtcctactttggactagagatggttcaggtagggaggaagtggaacatatgtgctttacaaaggtggattcattcagagtatttacgatgattgtgctcataaatgtagactcattaaaataaggcactctcaaagaggcgactgcttcaaaatgcagtgcatgtttcttacatggggaagttgaaaggatcatttacattttgcactgaaacttgaccctctattgagactttttaagacatcctcaacttccatcactcttttcagctatgtccagtaaaggaaaattaactggcgttccaagcaggtgacttgtgcttaaacagtggaaggtgagaacgtgctgtgtagacgaggttgcctgtgggtctctgtatctccccgtacgagattcccgtcctcgtattttccctggtatggtcatgtcatagttctcttgtcatctgtggcaccctagtttgacccatccaattaaggaacactttgttttaaaatgtgactgtcattcttcccggtttctcatgatctctatggtataagcggcaagcacgctgaataaagaataaggtgatgataaactcatccattcaaagagttatgttatgaaaactgctgttctctaccaggagcacactttaattttaaaaaagaatgccagtgccttctctgcccaccaccccgaatggaaacgaatgtaatttgaaaggctaaggtgggtgtgatgtggactctgaggtctgtgtgggtcactttctggacttgactagggtcacaaacttgaataccctcaggagtcaggcagagagtgtgaatcagcgaaacagagcaggtgtcagatcatagaaaaatacattcttgtgagcttgagaattatatcccgtgtaaacagagcagctgctgctgggcaccgacccaccgttgccaggcaaaaatgtgaggcgtgtccaatgtcgtggatcttccattgttcatcagcagcaaagaatcttcaatatgtgaaatcccctccggtttaaattccagtgcaggccaaaggcaatgcacctgtgtagcagcgcttgcaacctctgatgtagaaggtgattgacaactgcagccttgtcagtgccatatgctggtaattccagagaggattgggaaaggcatccaaagaagttgaccccaaaactggttgagtctttctagatttcggttactttcttttgataatggagagatttgacaagagctcgaagaattcttctgcaatagactagctaaccctttccctactatagcttgtgttgcaatggtatggtttgatctaccggaagtgtacttgcacgttatcaggggctttagacaaatagaggtcatctcattcttggaacagtagttgatttgccaagttttactgcaaacctgctattttggtttcctaaattagaattttggtatacagagagcccagtttaccttggatacataatagatttctttacgcaagagctagagatagtcattttgaatactagcttgatgaatgagtcctttagttacaattattcacatttaaaggtatatttagtaaccaataaagtgcagatattgaaaattttaaattggatgagatttatatacaaccgtggaacaccaccaccatcaagctaacgaatatttctatcacccacaaaacttttcttgtgaccccggtcatccatcctgtgttctaagttttgttgccagcacaccactgaactgttttctgtcactatgaattagtttgcttttttgaaatattatatatgccaaattatatgaaatatatatatacacacacacatctgtatatgcctaacttctttcactcagaataatgattttgaggtccatccacatttcttcatataaaaatggtacattttttatggttaagcagaattccaatatacagctatgccacatttagtttatcactctaatagacatttgttcccccctcacccccctgtttttagctattagaaataaagctcctttgattatttgcataaaagtctttgtggggaaaatagtttaattactgtggtcaaacattcaagagtggaatgggtgggtagtatgttttatgttaaacttttgaagaagtggctaaaatgttttctaatctggtagtcccattttaaattcccacctgagggatgaattttagttgttgtatgtttttgctatatttagtgtactcagcctttttagttttcgtcattgtaatgagtgtagagtgttattttacggtgatgtgaatttgcatttccctgatgaccaataatattagtattttatgtgcttattgatcattcagatatcttccttggtgaagtatctgttaaaatattttgcgcatcttcactgcaacttttgtcttccctttgagttatcagagctttctaaatattccagattcgagttctttgactgaaatatgtattataggtaattccttccaccaacatttatccttttaatggtatatatttaacaacattttttagtcttaaaaaagtctaatttatgttttttcttttgtgtttcctgatttcatgtgacatataaaaaactttgaatttaactgatttttaaaatattaatctgtattccgtgaccttcctaaattcaattaattttagtagttgttttaaagattccatgagaaatttttatggaggcaaccatgtcatctgcaaagagaggcagctcaactttcccttttgtgccttcttcttttgggtgctgtattgaaatgcccagctccttcagtacaatgttgcacggaagtggtaaaagtgaggaacacaggcacaggtgggatgtaatgaattctgtcatcatcatccacaatgtcttttgtaccagttattagcatattgcccttcatttccaaacctgctcttctttcctctgctttgtaattccgaaaccaaaccttgtacacatgtcgcgtttgccagctgccactatgttaagctttctcagtagagggtgctgcatggacacagcaggaggaagagacattcttactaatttctgcttctgattatgtgccagtcagcattgtgcagggtatccagtgacaatcatctccatagttttgctgtcaccccatcgggtagctcgccagaaggtcccacagacattagctggcactcgtgctggactgtgtggagtgttgagcctcagcatgcatttttgctgcccggtgggccactaaatcctccctcctcagccagctctgaatctcagccaggcaagtatcctcttttgcctttttcttctttgagtactctgcctgagcctccaggtaatgtcaggtcaatatgtctgccattctttttttttttttttaattctctttacccctctttgcgtttaatcttctataaattaatcgttcttcatactgaatttccctgatgagagattttgtctcctgcctagaactgcactaatatgttgcttgtagatttttcacaaatgttctttatctgcttgagaaagtttcctatcattagtagtttgctgagggttttattatgaataagtatgtaattttttcatatgattttggcatcaattaaaatggtagtatttttgcctttttttctgtttatatgttcaattacattgaattagttttgtgaaattttaatccaacttctcattccagagtacagcctacttggtcgtaaggtacactagatttttcaaatatattattgggtttgacttacagtagttcatttaaaatatttgtgtctgtatacatgaggggcttttgtctgtaattcccttttttgtagcctttttaagatttcactgtacaggagacggtaaattattaaaaaaatgagcagaactgttttctcctctgtttctaaaactgtgtaattttgatgtgatttctagataaaatttaagacagaaaaatctgctcctggagttttcttttagaaatcttaaataaaaaattcaatgtatattctagatttagggctgtatagattgtctctttcttctggtgtcaattttggtgaattatgtttttcaagatatccacttgatctctgctttttaaatgtgtaggtacagttattaatgcaggttgagcatctctaattataaaattccaaatcccaaatgttccaaaatccaaaattgtttcgtgccaacatgacatcataagtggaaaattccacacctgaccttctttgatgagttgcatatatactttaaaatattgtttaaaattgtcttcaggttatgtatataagatgtacatgaaattaaatgaattttgtatttagtgttgggtctcatccccaggatttctcattatttataggtctgcatatattccaaaattcgaaaaaagaaatcccaaatctgaaatacgtctggtcctaagaatttcagataagaaatactcagctgctgttattattctaagtccacttcaggtctgacgaatatatgataaaaatggatttttcatttttgatattgctgatttgtattaattcccttttaaaatctttctagccaagagtttgccaattttcttgatttttttaaagaccacattttaatttattatttgccagttgcctatttttttttactttactcaatttttctcttattttcactcttctatttattttgggtttagtctcctttttcttataagttaagtggaatataaagtcactaatttggctctctcttttttataaataagtagttaatgctatgtttccctccatataataatttatttgccaaacattttatagtgatttactagtaatttagtttaaaatattttctaacttctcttatgattttatcttcgtcctatgcattttaagaagcatgttgtatgatttcatatatttgggcttttcaagcagtcttatttctatagattctcgtttaattctactgcagttaaaaaatatactctgtgcaatttttattctttagatttcttgaaacatgttttccttgtcttttatcatcttggggtaacttttttatagttcagctataaaagtagaagaaagcgttatctatgattatttagcaaattttagactctggtcaaattatttaagtttctcaaactcaaattccttatatttaaaatggaaatattgatgtctatgttagtagcttttatgtgtatacatatatatgtgtgtgtaatacatatgtatacacatgtatatttcttacaggagaacagacttttagatagagcaattgttatttagttttatttactatttgatttttcaaataattctccatattaccttaaatttctactttctgaacaccaaacacaatggagacatatctttatagtcctactcttaaaaagggaaaaatgtatactcctataactgataataattaattaatgtgagtattatagcagtatttattgtgttaataaatatttcattcaccatactattctaattttataaaatgcatatataaaatcaatgcttaagaacatatttgtaattatgcctcatgtaacactatgctaattcttcagcatataaatataaatgtattattaatatttgatattttgttgtgattggcccagtactaatatttatgctgtaattgtcctaaaatgacttcattttatcatggaattatttaattccaaacaaaacatattatttcaactgatatgtgctatgtgatatgaataccaaaattgtgaggacatgcctggttttccaagttcttcctcttcagaaaacaaagaacacatactattaaatcaggtcaacaatagcttcaaaagtcttttttagtgacatatctttggcacttcaataaaaatatgacgtcccatgtggctagagtacagagtgcacagacggatagagtggaaaatataactggatgtatctggtgagcaaatcatcaaaacactaatgcaagatgcattagagcttagcaaaacgtttggactcagagttagtgacattttgcagttacctagtccaatgggcttttcttcttgctacttctactacactagctactgtcacaacgacgaccgctagttgaaggactaaattaattatttcatgaaaagaaatcctcactcaaaactggacatcagtcttgatgctaaatattgacattccctttgttaattaaaattatgtttatttggagaaggctatattgctttaattttgttacatgcatttatttaacagcatttaaacataacaacatgtaattagtctttcaaaaactatttggggtggtggtggtgggaaaaaatgtagacattctgcccaccacccttaaaagtaagtgataaacgttcatttctttctcatgagttaaatctagggcaaaagactagagaaattcaaccaggatatttattatttaatatttgtttggctttcgtaccgggaaaaaatgcttgagcagagaagtaaataggtaaattatttttgaaatagaattgcagtattttaatctccttctggtattactgaagcttctgttatgtttactagaaataaaatatggatttgttattgtggtttcttttgtgaagagtttatggctagagcccactctgtctattctattacgtgtactcttgtatttcatataccacacattaaaagtaaggtaagatggaagatcctgtaatgttttctctgaacagtgaagtcagaaatgttttggggcttcctcaagattctgaaaggtggcaacatttttactcagtgttgaaaacaaccagaaggtccatgcatcacgttttggatctaatattttagctagagtgatgtttgattgaaatccagtcaataatttaacggtttcccaaggcattcatttcagatctgaagctcagaaaaacatcaaaagccttcatttgttggatccaggagaaggctatgtaggcgataagaagaatcaagaaataaatatgtacacagagctagagaaaaacttattctctgagctttgttcttggtttcccaccaagaatataaaataggccttaggtccctaacagcactccgtgagtcctgcccacctttgctcttctgttcaaatctcagaaatatttctgcaaagtaaactgttccattgcagacatcctgcaaaagtgtgttcgtcaagcaaagctgggcttcctggatttcctgcttatgagggacatggctgagcttagcaatattacaaaagaggcgccattgaagcacatttatgaggtctgggcttgagttgggtaggatgagtctttccagatgggggaaattgttggtcacatgcacatcttatgggtggtccctaggtttgggttctggttttgttttcttgaaggacagaaacctttcatgtgacatttggcacctcggcagattgtaccaaaaaattcagcatgatgtggtagtgacctgtcaccatagtgcatattctaagtgatctctaaagtaaaactggccaagagaaatcttatccaaataggcagctccaaatcataaatattttaaaaagaaatattgcatcttaaaaagttaattaacaagtgttattgcataggaactgggtcccaggcattggtccaggttctggggtaaaatgagagcaagaagggtgagtgttcttggtctcttccaatgaatatactcatggaggagggagataaaaaatttaacatatgagcaagcaaataactcactttctaataatgaggaatgccaaataggaaattaaacaaggtgttggggtaggtaataagtggagtgatgaagaacagattcactgagggctttgatctgaaacctaaacaatgagacttcagccacatggagatctgggaagagtatttccagtgagcttactttataaccaggtgcttctaaaatattgctcaggatcgataaggagagcgccaccatgatggaatcagaagccaaatccagacagaaacctcatagcattgtctagttgacaggtgatttaccagaatgtttacctttctgtttctggcaaggcatttgccttaccaaaatatcagtcctactaccttgcatatttaaaatatggaatgacagggttattggagtccagtgttagatgaggttgtaatcagctctgtttacattccgttttctaatttaaacttgaatatttttggttatatctgtatcagtttatagacattatccaacaaaagaaggtgaagcaagtaatcgctcttaaagattttatttatattttctttattcactatttgtataaagttgcaaaaactaatttgattaaatcaaagtggcataagagcagatagtgataatagaaatacatcttgtcttagttggcataagaattttaaaacatgtttcaaaaacattttgaaaaaatatagagtcttaacatctattatttataaaaataagattaaactatcatcaattaataaaattttagaaacatgttagaaatcacttatggaatattaaggaatctattaggtaaaaaaaagaaatctgcttggaataaataaaagacaatacaatcagaattagtaggtctgttatattattaatatccaatgcaagagtaaaacaaactataattttaaaaattaaacagcaaaaaccaatgaataagcccagaagaccaaaatgagtttcttgtctttagttttttcctctggattctacaaataaggaagggtagccatgcatttatgccaatatccctggaaaacatacacaatgatgatcatcaccattggataagtgacaaatgagtcaagatgcttttaaagtcagtttactgttggctctttctcaagcgttggcatgtccaatgtcagctgtcagtagttgctagatcctgtatcttattctatagtgttttgtatttaaccaaagtttactgagtattataactgatgtattgctggcatgagagaatgagaaagtctttgtatttggtgtgatttagagagagtgagcaggagatataatttataaccagctttaaatagttagttttactcttacagactaaatagccagtgttcttaaaatgcaccaaatattggaggccacgatttgcctgttgtggtcatctccatgtgacctcagagttcttgagaaggactcaggtaggtggcatcttccctattattttcctgaagaaaacattcatttggaattccagtgtagacttgtacaattggtaaaccattcctcttgtttttttcaattctcaaagtgctcctaagtaaagtgcggaacttcaaaaaagaaaactaggtatttttgaagttttagctatgggatctgttcatttatttttatcacaacaaagggagtatgttataggaagatgtctaaatagtttgggcttaggcaagttgcactatgaaataagaacactccagactattgggtagaactaagtttatttcatccgaaaattgctttgagaattatctaaccgaaaaggtgatgtggttttttacagaagaatttgaaaaagattctggctagattcttaatctaagttttgaaaggggcactgtacaaacaaatagttatgggctatgaattcatccaaaacagtgaaaaaagaatgcttttgaaagaataatatatcagaaaaaggaaggttttgatagattatcaggaataagatggaaatagtcatgtgttaagtattgaagtagtattaattgaaatgtagttccattttatttttatatttggggatcctaacaggcagtttcaaaaaattaacagaacagtttatgtgcacaagatggtataaggaaataacaccttacactcacaaaaaaatatatttattatttaagaatgacttttggctatagcgcctcttttgctttgaatgaagtgtttatcctcatagtatgaaaacctattggccctcacacatttgctaaatatgcaatatttttcctactttaaaattagaatttggacatttgtaagcaattaaattactttgacctaatcaatgaggaaattggtctgcatttctaaataacggttgtactttttacaagtcagtgagctattctttcacaatttctccatatgttaagataagaagaaacaccattgctgtatattatgggtgtctgagagttttctgggtttgggggaagatactgcgtaaacccaatgtgaagagattatttcatagtgccttaagctctccacgttctatgcaggtgtgttgtgttcacatgggtacacacacgtatttccttctgtttctctttgcatggagagtgtaagggcgataatagatttgaaatgggtagttgctttttcctcttcttgtgccccacttattttgtgtcatgcagttacagaggtactaatagattatatcagtttgtagatctgagacaaataggaagcctttctcatctgaaaataactgtgaagtcattagcgtccaccaattctgatttcagggaaaattactttgtactacaaatacgactgtttttcagacaaatcatagaaaattcataacatatttgaaaattatctgagattggtgaacaattttttactctagagaaaatattaataatactttatatctttaggttttcatattattcatttttaaaaaaataatgtctgattatcttttaagaatatatgcattttaaattctacagacatattgtagtctaaattattatctcaggtgacagtctttccactgtaattgaatattttaaggaagtgttcgttccatgaatggtgtgcattcgtgcatccagtgtgtgtgcgtttgtgtgtgtgcgcacgtttgtatgtgtgtgtacgtgtacgtgtgtgtgtggtcatactcagcggactttcctctggttgttcctgtgttctatgttctaggtttctaagttctagatacttccgcttgtgctatgttacataattcttattagtatatgaatcttaaaaataaagagatcagtttagaggtgacataatttactaaggcccaaataaaaagcaaaggttagaggcttatttaggtgctggattttctgaccttaatatctggactgttttctgtcaacctcatcatcactagacaagccatggaggtaatggtgggagtgctaccttcaagacaggattttctacagagttttggcctttgtgtccagtccgtttaggtgtgaaacacaaatgtgtagcctgaactagtcttgggtccatctcctcaatatgcagtttgctttgctggcccccaatgccctttgttttctaaacaatgtctttcatgcataactattattattattattatcagaacttaaaagttcattgtttttattgcatctctgtccgttctcacattggcttgccagtaaactgtcaaatcttggctctatattgcttatcataattttgcatgtggtatttcagggtgtttgtcctaaaatttttattaggacatgtaaaatctttattttccatgaagattcctaacaataaaaattcacaatacaaaagaaaacttctctatctctactaaatttcaagtacagaagatggagtgattgaggaacgttttcttttttttttttttttggcattagacagccttctgctttcaaaaataacaccatcattgaaccatttcccatgtgaatcccagtccctgggtggtcttgatgttagcagtgagagaaagagtttgttaaagatccaaattagaattcagtcttctatttttttcacttctgaatgatttactactgccatttgatggaaaattgacattttttgcatataattcattaagggttgtcaggcaaacctcgctcaagtcacttagcaaaaagagggtgaaaaaagtccaagcacctgctcagccatcacttaactgtagtcattgtgtgtgaaagtgctgggcttacagttgcggtctctgatgagagcctgccacactagtagtgtaagtatgctcttccaggccatggtgaacaggtgcagcaaacttggttctggaggcaactaacctagttcatgagtagcatgagcttgcctaagctctaatttctctttaggatttctctgtgtgccagtgtggaggtgagaatgacaaccctgtagacatggccacctgcggtggtgtctactctagtgcaatgggcactcggagcatggatggcgtgccttggctcatcactctgtcatttaaatacaaacaacaatttgtacacactcaacaaattgttttctctcttaccaactggacattatttaaatgaattagaattgttcttgttctcttatgggaagagcaatcagctcgtgtttagaattgtgtacctgtgtgtgtgtgcattcagctataagacaagcctaggaaagtgagggaaaaccagccaccaaatgcaaaacaagttcctctagcccccttacactgaattttcctgggaatctaatgttatgagatcagttttgcagggactgttatatctctagtccctgtgtcacagcatcagctcttcccataattagtacataaaatctctgcctatcatgttcaggaaagcataagaaagtattctagtatgctctgattcactcaggtttgtgctcttgtttagcctctcttaaattctgtcaaagccaggaagagacagaggctggtgttactggtgctgtttgttgagtgtgcatagatttgcaggtacacacacatttgcacacacaaacacacccaccagcctccataccctgagagtggcagggatgtggcgtgaggtttgggtggcagttgagtagatggagaaggctgatgggtcccctgagtggccttacccttgtcctcatggtttctggttcatggctcaggtccaggcacacattcattccactgttcctccagttcctcggtgtggagaaagcttaaaatgcaccaaatattggaggccacaatttgcctgttgtggtcatctccatgtgacctcagagttcttgagaaggacacaggtaggtggcatcttccctattattttcctgaagaaaacaatcatttggaattccagtgtagacttgtacgattggaaaaccattcctcttgttttttttcaattctgaaagtgctcctaagtaaagtggggaacttcaaaaaaggaaacaaggtatttttgaagttttagctttgggatctcttcatttatttttatcacatgtgctggaaacggaagtgttgaaaacaaaggtgatgaaggcagtgtgcctgcagccagttttttttagcactcagcgttcaagccaccgaccgtctccgatcaggtctctgctcctagtgtgagatgcattccttcatgaaaagagtctgtgcctcctcttcccagcactcttctatcctcacctcctagggacacgccgggaaccatggctttcttttcattccaattagatggttaaaatttgactatttcagacctgagcacttaggaggaaaaaaacacacaaattaagctaaatgaaatcctgaattcacaagtaactattcaggaatgtagaatttgtcactgattgccagctgacctttaagatgcattatgaaggtggcaggcacttcaaaccctggtgaggaattaccattttaagctgaggttaaattcgcatatgtgtacaaagcaggagaggaacactgagtaattttgctacattttgaatagatgactcacaaatgagaatatataattataaataatattgaaaatacaacatctttagtcatgatgaaaacacacagtaaatgaacacaagacacactttttctcttaacaaaatgacttacatttataggaggttaaagagaaagagagtttcatcttctggtgaggtgaggggaagtgtaaacacttctgggaaggcaatttggcaatacatatacgggtcttaataaattgcgatagttttatccacaagttttatatctaggcaatttgaagaaaactatacaatcaggaaatggtacacactgagaaatgtttatggcagtggagtttaaaacattaaacaatcaagaactaaccagatagccagtggggagctgagttagacccagcatcggataaccatgaagtgagctttgtgtagtcttcaaagagggaataatacaaactttcatatttattggtatgaaaaggttttcacaacacaggattaagtgaagagtaaattgacgaatagtacccattgtaagatttcctttatatttaaaaactgtgtatacactcgcccagatgtatctataaacccatatagagaggtctagaagaacatattactaaacagtaacagccattatctctgtggagaagagtgcagtaggcaattctctatggtcttctttcacttttcttaagtttttgtaaatagaccaaaaagaaaaaaaaatggtagttacatttctaagggaaaaagggctgctattttccaaggaaaggatgcagatactaagttttaaaactacaattttatcgaatgtgatttccaacatagttatgtcattataactcctcatggacaattaaatgtcattaaaatgattcaaaaacgaaatcgtataaggttttcgccacacatgcagttgtttatactcacaggcatgcatgccatcctgaactcttgtgaaaggcaatatcaaccatgttattagattaagtaacatataattggcagtgtagtcatgaagaaccatttgcaaagctgttacaaccataaaacctactttttgaaagaataacaaactaattcatgggatgaattaaatcaactatttataatcaggtatttctaagtgtactgacatgtaactcagccatcagatatttaccaaagcagggaggaaggatatgtatgacaaaacggcaaacatgatacctcctggggtattctttataaaggtggcatcatagaaagagtggtgtttatggagtctcagcttgggttctggagcctgtccctgaagaagacacctgacccctttggaaataaatccttaaccataaaaagaacatatatttgaaactttctgcatggtgtcattagaaagattaaatgattgatgtgactcacatgcttacaatagtgcttgatatgttgaatttaatactagagggatattgctcaatttcatggatccaatagtcagtttcacgaacttcccacttgatctctatgaaggatttagtctctctttcttgcatctgtatccccaagtcttgtttacatcctagttttaaatgaagtagaagaaagcaggggaagaaaaggtgttcataacctattagtctttaaatgacaccctttccctgaaaaggagagaaatagaggtaggggagcatccttatagcaagaatttggatgaaatgatatctaattgttttttttttttcctgaaccctgacacaaagcaatggtcattcccataggtttagtaagctattgaaggaattaccaattaggtagtttaatagccagcataggaatacttacctgataatttccttgtaaaggggatccttctttttgaaaatatcctgcatcccatctctcttaaatttttaccagagctatcagaaagctcagggcatttgatgcttggttttatcgtatattctcaccataatctggatttgtttgtttgttcctgtttcagtacttcatccctgcttctttcttctttgacttttttctgttttcttgtttaaattgctctaaaattggcaatgtttcctgtacaatctgcagcgtaaaatctttggaagtcactggcctattaagaatgggatgtcaaaaatatgccattttgctaataagatcatactctgtgatggcagtggctgtttattctgctcacttttgtacataaagtgtttagtacaataaagaaagcatagtgttgtttaatagctaattagtgagttattgaattcatatattaatcaattaattaacataacaaaataccccagctaggaatgaggctttagatcatcagctttcatctcttttgtttttctgagacagggtctcaccctgtcacccaggctggagtgcagtcacgcagtctcggctcactacaacctctgcctcccaggctccagcaatcctcccacctcagcctcctgagtagctgggaccaaaggcacacaccagcatgcccagctaagtttttcatttttttgtagatacagggtttcaccatcttgtccaggctggtctggaacaccagagttgaagcagtctgcccacctcagcctcccaaagtgctgggattacatgcatgagccagcgcatctggcgagtatttcatcttgaggatgagaaaactaaaactcagtaacctgaaagtggaggatttcaagtttcagcccaactcctcagatttcatgttttttttttttttttctacattcaagtatgccacattcctttgagcacctcagcaggaaaaagtataacattgtgttccagagttaatcaaacaaggtttacagggcttaactttggatccatttttaaatgttaattttaaaagaacaaacaaatgttttctagttccctgttctatagaaagcaatctcttcttctgcccatatgccttagcatgcttatcatgtgtatcacacattcagctaggtattttccagcctcctgaacatatgaactcataaaagaaaacacatcgtcacagacttcacttctgaaatgcctgaaggataattttcataatcccacaaagaggactttaggacattgcttaataaacggtgattaaaaatgtatggcgggcattgctagcgaaaatgacgcatttgtagtataactttgccatcgcatcccttatcttgacgatggagcagaataattgttaatgacagtactggcgtctcttatggagattccacatttaaacactccaaataatacatcagtttcttgacactctgtctctcctcctccacgttcaatccactggcaaatcatgtcaagtccactttcaagatagattgagaaagcatccttttgtcgagccctctgccactccaccatgttccggtcagccaccaccgtggctacctgggtcagggtagttgcctcctcacccatctccccactttgcccttgggcctccttagcccacggtgcagacttttaccactgaaatcaagtcataaatctccagctcaaaatgcttccatggatttccacccctttggagtagaagtcaaactctttactttgccctgaaaagactcctagggtcccctctaatgcctccctcttcctgtcttcacaccagggacactggtcaccttgttgttggtttcgaatacaccaagcaccatctcctcccagggccttcacctggaacacccttttctgggcaaggacacaccctcacattatccctgatgccttctctgaccactgtatataataacattgatacaggtgggctggggaaagtcgccagatgtcagtgagacctcaacactagccagtgtccaagctcttgacaccacagtaagaaggaattcaaggaagagtcagaaaatagtgaggaagattcagaaaatagtgaaagtacagagatttattgcaaagggaaaagtacacactcaagaaagggagtgaggatttactcaagagagagtcactctcaagcggtttgaggctgctacgtttactgttttctttaaccaaggggtggaatactcacgaagattgctggaaaaaaggtggaaattttttggaagtgtagtgccatccatttttacaccaaaaaatggctggcgccagaactctcatgatgttggcggacatggagtttaggatgctaatgagcatttaatgaggtccttgttgaaacctaggtcaaattcagcaccatgttgaatccagtttgtcttagccagcttggcacacaccctgggttttctgggtcgtatcaggccctagcttcacaactgtttcaacagtttccttttgcttagtcacgtgaagttgttgcctgcaattttctattctccagcaactactccgtattattcctgtctcagaatcaatagcccgtcccccgcactccctaacccttaacattctgatacgttcaaatgcatttttttttgttatttattttttccatattttctacttatcactagcagaattatcttataattacctgtttatttgcccattgtctacctctcccactcctgccgacactatcaattagttccttgagtacaaggatcgtgctttaaaattaactgtctttcccaggtaaaaaaaagtgctccaaacacaataaatattacttgagtaaatgaataaacatatgaatgaataaaaataatatggttgaagagcaaatgatcgattttcaaactttaccactggatttcctgaaatatggtgccacatgaaaaaatttaacttgcatcttagcaatttccaaaagaaaaggatgaattatatctactcatgtacaatgaaataaagctatactgatataatggggagaaagttcacggtttgagttatttttgtgatttcactttaattaaaatgtcatattatttctggatttataaaattagttttctatttggggagaaatgatactcccctttatgtcaatttgaaaatttactatcccttcataaaaggtctttattagaaaaaggtctttatcaaactggaggatagatcaataatacaatattatgtacagaagtcatccaagtgaatagaacacatcatggttgactgcaatcttaagcccatatttgtctccgttttgctaatttcaagtggttctccctcattacctggtccttgagagaacagtgctgtgtttcagcagctgacagccctgctgccattggccgctgttgtcttcagccacacacagaaccaagagtggtaaagggcttggcatcggatgatgttgtaatcacagcaggaagaacagccactagcagcactgtgagcccagggagccaggaacaagcaagaagcctcacctctggcacagaaagaactcttttttttttttctctccctgtttccttgactgttttcttcccagtccacaaagaaatcatttataaacagactctaagtcacagtcccttgtcttaggttaatttattaggttttatttctaactgaagcatattttctccttccaactcttagacctgcaaggcgtgctgagtggagtgcagtgcccagtgacagttatgtgtcctgcggtttagaagctcagtattagtgtgaattaatcctgcaagtcatttcagctcgatcaattttgaacgtgagatatagcctcccaccaccgcatccttctcaggcttccaaaatagaaatagactccaaccattcctgtcagcttggtgtctgggctccatatttcataaggcctggctttgtccattggctctgctctggtctagcttagacacatcctcgtcataaaaatgtttccatctcccagcattgatctcgggaacattccaaatgtctctactccagcctcatttggctggaatttgacacggcaattagaacacgaacccttgtccaccatcaagtttcacctgccagtgtttgagagcattggaccggtgagcttgcaatggcagcgtaaattgattcccagatttacaagtcacagatcgtggatatgagacaaccattctttttatgcattctacaagggacagaagtataagtatatgttaaagcattataaggaagataattttaaaaaaggaagatactaggaaaggtcatggttagattttattgactattcatgattttgcctcccaaagtctttagagaaaagataattatcatttgcgtaattgtaatttttctgttaactctgtttcctggtcaattaggtaaattggcagtcgggcataaaggtaagatgaatcatcataatcaggataattctggggaccattatagtctcattctatgttcagagtggtcctccaattctttatctataaaattaggtttacaggactcaacctctctttgctcatagataattcattttgggttcattgcttcaagagaacccaccctgtgaaaatttcttcttcttcttcttcttctttttttcttaaaggtaaacttcatcggtctaacgttagtatttgccttatttgtaaagttaacgtgtccatggttgctgtcttaatttcaagttatatttgaagttgttctgtcttttttgagaattgtgaacacggtgacataatactaatttcagtgatttttaaaatactttggtacaggttaattttaagttccacattagcttagcaggagttagataggactttggtggccagccacagatatcatgggggttgttgctttaatgttctggacagcaccacaggaagccttactcgtatctggcatagacccacaagaacaaattacatctctggcaaagaatctgacatgcgcaagcatgattctgaaccccgaacaccgtcagagtcaaagtaaatcttcaataattaccttttgctatcagagtactatactgacagatccttggctgaaaaaaggaggtacaactaaatattgaggaagaagtagatctatattcaaattttacaaaattaactgcaaacaatattttgtgcataaatgttaccattaagcccatgtatcatcatcattcccaagtaggagacatagtttggaaagaggataaacagattggtgatgttctgattccatttcatttgcagagatttaactttagtttcactttttaacatttttaagctaggtattctgttgacaaattagagatttagaaaaaaataaaagcgttcatttattgatagctattttgatcataatcaagtcagaagctaatgaccacgagaagaaatgaagcgggacaaattcatgaacttgttgatgatccttccttcctggagatcctagtctttacgcacgcgcacacacacacacacacacacacacacacaatgctatttgtcaagagtaaagactagaataatatattatatatatattgtatatataaccatttaatgcatattcctgttatatagacaccaatgtcttatatctattgtacctttatttgtactatttatgaaaaaggtagtagtcaatcaaagttaaaaggcttaggggtagagtacttgttgctaactttccgattatgtgaggactttggaatagagttaccactgtaaaaccagatttggaatacagacataagtggaaagaaaaagaataaaaaattgtttatctgtctatgataacaactaagttgatgagtaagttaacaactgtcaataaactgatacatatctttccagtttctatataaaattctttttatagtgaatagattataacatgtcaatttgtaatttagaaatgtatatagatgtacattagtgatcatttacaaatacaatcatatcccaaatcccccagagtaatacttataaaattaaaatcattaaaattaaaattaaatcattaaaattaaaaatcattcttcaatatttaaaatgtgtgctgctttctcaaacattggaaattattgtgtttcattccaacttctccggtacaccaaaatcatcctaaattgtctaacaatattttttcattagcatacaagccaacatttagaagtgaaagaaaatcactgtttttaatgtgacagaaacccacgtcattttaaggtacttttgaatgaggtgattatattcattttattttcatgttttcgcactattttgcaaagctagctaaatgaaatcatgaggtcacttaatatttgttctggttttctttccttttattttacccactgcttatcttttaaataggattaatacttacctttattatttatggaacatttgttaggatcaaacttgctaactcctgtacattctgaatggagttttaaaattccaaataatggaggttcaccacatttttaagtgggtttaatatataatgttttgatatgagtttaaattaaaatgatatattgaattcttaataaaatagagttgaatacaaaaaaggaattgattgaaatgtaaaaaaaattaaaggagtatgaaaaatttgcagcaggtcatggttcaagaaaagagaattttcttctattgctttggtgtgcagtcagtatttttaagcacataattagaactgatattttcttaaagtaattaatatagctatgtctccataaaaaattcaagccaaaactattctcatcatataatttttattcccttattagatatttagaattcaaattatacttttagttcatttttagaatttcagttggagaatcaatattttattattaaaaatagttcagtctttactaaattacaaatagtctgaatatcttcttttttatctatttttatagttacattcatacataataatctattttaacctagatcatatcattatatgatagcgttattatttatataattataataaaagatttctttttattgtttattaatacaggataaagtcagcttacctttctaaaaaatccagtcattgtaaggcatcatttagacaatgcttattatagatttttctgcagtagttatctgtagatgctggtggcttccttgtagataacaacaatgaagatcttaagacaattaagtcatttcaagccaagaagtatttgccacttgccctaacatgataagaaaatacgccttcaaacttctttgaattttatagaatatttctttacttgtaggcacgttaaagagttttacatcttgtctcaatgactataatgaccaatatgttcctaatatatttacggttttattgtatgcgtacctgagatgtgctggacagctctggccatattaaataaggtttcagctgtcctccttataaatatttcaacaacatgttcctgtgttccgtatcttggaccagcaaattaatagtggatctctcctggcagtagaagcttctgtttcagcttccttatctgctatttggtttggcttcggacctctgaagtgccttatttgtgcagggcccctttcttcctcttttttagtaagagattttctcttctaaaataactcccaacaacatcaattttcaatgacatagggtggaaaggcaatgcctcaagacatgaaataagggaattaattttttacattaagccagttcaccttagggaactgggggagcagaaagattttcctgaggctcttatctcaataaaggcaattggtaactttgctaatacatcctttatctatttctatattcattcttcttggggaatgcctgctagcaaatgtcatttggaaggtaaagataaaagctttcagagagtacagttgctggctctgaggaggttcctccagcacctgtgtataagcttcacaaggaattccttcttgttcacactctatgtagacggttccaggctgtgccctgctccacagtgcttctgactcagaacccagggtgaaagatgcacgctaacctcagacatgctcagacatggataaatcaagtttactcacttttcatttggtcaaagttaatggggcaaatatatttttctccagctacagggaagcactgtaagtcataatgccgtgagtggagatcacgatcccctcattgcatgatgaggggtatggagaaataattgcaaaaatgagacatccgccatactttgtaatctgtaaatgttgaaggctggcaggaaagtactgaactcttactactaaagtattcaattcttaatactaccttttatcatctgtatgaccatagaagttcctttatgatctctgtccctccttgtctattctgtaatatcacacctgtcctaccaacttaacattcaggaacagatgagatgatccctgtagaagtgggtctgaggctgtgaagaactatcctaatgcaagttatgcaaatgccatgataacagacacttcagagaggccctggtacagctccacctctgtctccaaggggacttccaaacttttgcttcgctgtcactctactccctgtcttattctcatgctttttaaaaaaaatctggccaggtgcggtggctcacgcctgtaatcccggcactttgggcggccaaagtgtgggggatcatctgaggttaggagttcgagaccagcctgaccaacatggagaaaccctatcactactaaaaatacaaaattagcaggcgtggtggcgcatgcctgtaatcccagctacttgggaggctgaggcaggagaatcgcttgaacctgggagacggaggttgcagtgagccgagatggcaccgttgcactccagcctgggtgacgagagcaaaacttcatctcaaaaaaaaaaaaaaaaatctaattaagagggaaattttttggaaggcatttttacattactttaatatttttcttagcttcctcaacagtctgtataaatgtggcgataagcaaaccttttaaagtcagaatatcttctttagatatgtaagtttgtcaagattgagagattgatttcttacgtctgaagttactaacaatttatcctcacgccttagttcccataaagagcagatgagtttacaccctctgtctttctgtgagtagaaaagaatgccattcccctatttttgtgaaataattttgtcaatttcttatctaaacattggtggtaatctgtgatatttaatttcacaaataaggtttgatgttgaatttgaataaatgttttctttaggatggagagcacatcaggaaatagttataatcaactgtgttcatttataattttcatacaaaaacagatgtatatatttatttagcctattatatctgtaaacagacttcaagaaaaggcattgatgatcacttgaatttatttctgaaataaggaacatatccatctgtagctatgctttcatattggtcttaatagctatatctttaaacttcaccgtttattaagtctatagctatgactaactttccatttctacccatctctatatttgctacatagagtacctaaggtcaacctggaagtcaaatccagtgtcagagtgggagagagagagagtagagtatcacgtgaggagggtccatggccagatatggaaatgtatttgacatttgcactcctgttctgcgaccacagctcagctacatggccccagctaggcaataagtgctgagaacgtcagcccgacctagactgccaccctctagtcctaactccacagtataaaagggaaggacaagccattggtgggtacctactgatctgttctgcggtaaccaaccctagactttcatttctagttatcacagtgaacacctccatggaggtggatggacagagcatatgcgtgtcagatccatgcatacctgggttcagcttatgaattatgctactttgagcagtttacaaaaaactctttgaatgtaactttaattgtctctaagttggagatcatttgcatatgtaggagcattattgtgataaacactaggaaatatacttggcttacagtatccactgtgtgaactgtgagaattattgttaccattgtttggaattaaagaaagctggttagtggttgctatgactggctatcacctgggccatgctgatggtgaaatagtttgcatgtcattcctacaaataaccaaatgtctaaaataattaaatgagatggacagaagtgtggtaaagtacagtatacatttatattcgttgacgtaacttatcaatgagatttttttttgtaattttatatattgtgcacttagtgtaaaaaaaaaaactgatggtttatataatttagaagttccactcaaatttgagcttccactctgtcttctcttaattaggtacaatttactccaatttaggattatcaaaaattttcctccttgcattctcaacagatctttaaggaaaaaaaaaaaattcttccagggtgaccatgctattctggggttaagtctgtctagttgactacacagtaatgaagccacatgatccaccacagtatacagtttatctccttgcttggacacatggggtagaattatttaatctcattttgtcctatctgaatcattgtgctttttgttgtcattcttattgttttaagttttaagttctccctacagatacagtacgttggattttttaataccttagtctggaaggcacgttctaacactttttacttaatcctaacattgtctttgtgtagagttagttcatgttacgtggattctttagaaataagtaaagagtttaatacatttttaaaccattttataatttttctggtacacgtaactttcttggaagactaacaattggtttaacatttgatttagaaacaactgaaattattgtttttttgaagatcttcactgactctaggaaaaaagtcattctttttttcttctacaaaagtaaaagtagttcttccttattttcataagcttggacaatacaatttgttctatttaatactcaacctatttctgtgattgaaaaaaattttccacctacttagagctttattttgcttcaataaacataaactgagtaccagtacccacactggcactaattaatgcttattgtcaacgagtgtaaatatttcagaggaaattaggtgtctagattcctagcatagttaatttttattgagttgatttaatatagaaacaaatgtatctaaagtggattttttataatcttgaaccaatgtggagttttccttgcatcttttggcagatacattgtaactaagcagccacacctgtagctggagtttggtattctgtggtcatccatcagccaccatcactaataaaataactcagatttcatgcctggctgatagcagtgatttccatgaccttatatgacagagctgcatccacctgttagagctaatatctaggcaccagcccctaacctccaacaccattttcagctgtttagactgctaggaattcagcatagtattcgtaattcaaatagcaaatccaaatcatcattgtgtttgagcaaggtgagtgtggcataaattagattggagagctctcaggcatgtaaatattcatccctacaactatgataattccgttttacaaaagctttatttatctaacttgactttttattggagtgggatttgtaaagagatacaggggaagtttgaggaagcatttattctagctttttattttctgtgatttttgcatctaattaaagacatgcaattgtgaatattgataaatgttctaaagaaccttatatctattttatatataatttatataaaaataaatcacatatattttaaaataattagagatgacaatgatgtttattataagagcagccataattttagtacccaccatattctccaaatcttacctaattaatctgtgtctctctcactgcatcagaagcttctgtgagtttgggggacaagcaggctcatctttctagctcttgtggcaagcacagtgactggcctatgaaagtcatcccattactttttaaactgaagtagaagaaaagctaaactacagtttttcatgtgatataacatgatggtccaaaggagttaataatatcctttaacattttttttctgattgtgttatagtatgctacagatgtctcaagtacataattttggtcttaaatattccattttcatttctgtgttttatttctttttttgttgcattgttttgggaaataagttttatttcaaatgggcaaaatagaaagatatagagtaactggtcaagtatatttttaaaaatacaagtaataaaatttagatgaaactcaattcaaagcattcgtttacaagaggaccaggggtgaatttacatttggggatggatatttaaccttggtcaggtcaacatacctcacactactttaggtctgtgaaatgagagtgccatctctcctgcttatttgaaagggttattttaaggatcttataagttaatacattgatatctatttctcaaattagaaatcaaaggcatgggataatatatcaccactattgttattagaaattacacactttattatttcattcaatcagcatcacaagtttattatttcaaagttttgactgaggagaggaaactgcttttgttagctgcaaatgctagaaaaaaaaaaattgtgtgttgtattagtctgttttcatgctgctgaaaaagacatacccaaggcagggaagaaaaataggttgaattgatcttacagttctacatggctgggaggcctcagaatcatggcgggaggaaagaggcacttctaacatggaggtggcaagagaaaatgaggaagaaacaaaagcggaaacccctgataaacccatcagatcttgtgagacttattcgctatcagaagaatagcatgggaaagatcagcccccatgattcaattacctccccctgggtccctcccacaatatgtgggtattctggtagatagaattcaagttgagatttggtggggatacagccaatccatatcatgtgtgtatttcgtttgttccttattgttcctttcaaaatgaactgtttttgaatgaactgaagttagaccgagtgttcaaacagcaaacgtactattaaaaggaaataacaacaacaaagttaacaaagacaatgttgcattgatttaggaagaatatatgcacttcagagatttaattattaattattttttttttagaaaagcttatagcttggtgagaaaatactgttaaggaacagagtcttgtgtgttatacataaaattttaagtattatgtctatgatgaaaattatttgcataatgatcaaaattgctatatttgtttagaaatgaatagaaaattgtctttgacgattcagtctagaaatcatttttccagaaagtctccctgagacccttagagaggaggtttcgtttttgaaccttctctaaatctaatcttgaagcttgggttaagcatctctcccttgtgcttcccgcttttacttaacaatagttaatatactgtcctatgattttttttaacctatcaagttctcctaccaaaaccaaacttacttgatgtcagtgggtatatattattccagacttatgtattcctgaagcaagttttttagatactggaactacattcattattacaattgcagtaacacacagggaagttggcccttgagagaaaggagcaaggttgggccatgctgtgggcagtgtggcaaacagggagtgttcaagtggtggatctggttatggggagatgtgggatctctggatttgaggctgtacaagtggtacagttcatatagtttagtaagagcaagatttacagtcaggccttaagagtggatggctgcatgcaagatcattccatgcaaagaaggaatggaagatccatgtagacgtgtcagtgtccaggaaggaaaacaggagctctgaaagagagaaaaaggtgctgaaatgttctgtgatggagaaatgagataagaatggcatttgttttgctttgttttttagaaacaaagtctacctatgttgcctaggctggcctccaactcctgagttcaagggatcctccagcctcagcctccccagtagctgggactacagacatgcatcgcagtacccagcttcactggttatacttaagtaaggaaagggacattgtttaggaagcaacactgagaatgtatggtttctgtgccaccagagctagtctacagtagacattagcatgaagcaaaaacaattgccaccatttgagaggactccaaaggaagccacagaaccagaacagtcttaccaggcctttccattgttgttagcatattgacaatgtatagcattatttggatggatggaatgaaaatgaatgcatcaatagacaaatgaataaacagataaattgttgaatcgacatgattatcctttgccttagaaatcaccctttatctactctttcctttttatttatcatattataccttcctgtctcagaattacagagttatagccaactcaagccaatttgagttctgttcctacgtgtctacattttaggatgtttctgcaattaattagtaacactctttcactgtgaaaaactaaatgaggatgctcagaattccaaattccccaagcttttaaaattccatccctattaaagttataaaaaaaggcacacctatgtttacacctctaaggtttgttagtgacatacaacaaggaatccagtatattccagatcccaaaatttattagttttatctcatttctttggcatcaagtatgaaaaacattcaactactgaattataatatgtagtctcaatatttaaaccactataaccatccacattccttttacagagtcatttctcttcagcatgatgaagatttactaaggaattgtgtcctagacacttatctattaaggtgggggtaacatcagaaatatgatgatatgtctgccctaaaatagcttagagcctggggaggaaagatagccatgtgaacaggcaggtaacaatttcaaatgttaaatggaaaggttttagttttgattacaaaggcaacacatgggcagcagagtaaaatgtaggttttgaagttgaaagaccaggttcaaatacatatttgcttcttgtttcctgttatgggttaagttgtgcccccctccaaaaaaacgcacacatcaaattcctaaatcccaataactcagaatgtgaccttatttagaaacagatcatttcagggtgggtgtggtggctcacacttttaagcccagcactttgggaggctgagatgcgtggattacttgagttcaggagtttgagaccagcctggccaacatggtgaaatcctgtctctactaataatacaaaaattagccaggcatgctggcgcctgtattcccagctactcaagaggctaagacaggagaatcgctttaacccaggagtcagaggttgcagtgagctgagatcacgccactgcactccagcctgggtaacagagcaagaccccgtctcagagaaaaaaaaaaaaaaaaaaaaaagatcactttagaattaatcaagttaaaatgaggtaattggagtgggtcctaattcaacatgaccagtgtccttataaaaaggggaaacttgacacatagacagagaggcacatgaggaagaggccatgtaaagatggaggagactgatgattcttccagccaaggagcaccagagattcccaacaacctccagaaggtgtggagagacaagaagggtcctccacaggcagggtttggagggaacgtgatcctcctgacattttgatttcagactcctggccctcaaaactgtgagacaataaattcctgttgctttaagctggtctgtttgtggtattttgttacaggcaatcttagcaaactgctccattctctagaagctttttgataaagttctttaactttattaagcatgctaaccttttttgcaaaatggaaatgatgttgcatatagctaggaattgttggaaaaattaagagatctggtatacaattggtgcttattacatggaagtagtaactaataattttaaactaaggtcttttcagagctttaagactccggatcacaaaaatcataaaaatatttctgtcatttgttattttctactttcattatgaagtgtgattatatataaatattaagtgctacaaatagtcactttatgggctatttataattgaaaaataatccaagactctaaaagcgttctcttttatgtttcactttcactaaatggccattctcctgtgcttaagggtatttcagttggaatgaaacattatgccaaaaatacataattagcactaaaattattatgcttaattttttatcatgacaataacaaggatttagccatgctgcagaagtatttaattaatttgctatgtatgcgtaaagaggagagggaacaaatggggaaatcatattaacgctcatgttcctgcggaaattccattaaccttgcttttcagcagcagcaaaaggcagattctgtagggcccatttgtatgcacttcagtgactgcctggtcctctcaatgctgagacctcagcatcctccattcaccctaagaaaggaatgagaccaagaaatggcccggatgcattatgcaagatatcgcaggatgagatgacaccagtgatttacaaacccctccagcatgtagaccaataagaaattttctaaatagttttatgaatttcacaggaaagcctgagaaaacacatatagaaagaaaactacagcaaacctcacatataaataaatgctgattcgaaacttctaaataaatattaacatagaatttgggagcaaatgaaaaaatcaataaatatggaaattcatttcaatagtattacaatgattaaacaacaggatatttcgtgtattggtagattttagaaaacaatattttaactaagtataaatattaaaattcgtagataaaaatttagcacacattttggattgagctttataaatgtcatcaaaaataaggaaaagaggccgggtacagtggctcacgctggtaatcctagcactttgggaggccaagacaggcggatcacttgggatcaggagtttgagaccagcctggccaacatggtgaaactctgtctctactaaaaatacaaaaattagctgggcgtggtggccggcccctgtagttctagctactcaggaagctgaggcaggagaatcgcttaaacctggcaggtggaggttgcagtgagtcaaggtcatgccactgcactccagcctgggagatggagtaagactccacctcaaaaacaacaaagcgataacaaggaaaatgaatacggaagagtatattttttaaaatatttgtgacaatttaatggaataatttaaaagcattccaattaccactgtaaatataccactttcactattctgtaataccctcctggacactttagttactgcaactagataagataataagaggcacaattaaaggaagattcttgttgggagcatgaaatctaccctgagagtattatttatgccacagaaattggcaaatgttataaatcaggaatccgttatgccagcaaagccgctcgttaaacatctaccagcatgtccctactgttagacgtccctccggtacctcagatgcaatggtccataagaaattcactggtcccatcctggccgcattgcatgacctgcagcctgttttgcctttgccaatatctccatctatctaggcgtttgcactagcagctgcctttcctccgatctcctgaagtccctcagaatgtctgcccaactttcagcctccccaccggtcccttggtcattactttctcccctctgccttgttccagaggccccctagacggtctttctgtagccactgcctcattgctgagtacattcccctcaatacgctaagtatttccaaaacagatcctatcccctcacttcactgctttaaaaccttctctgcaattttcattgcatatttatattaaaattcaggcctgttccaatctgacactgacctacatacttatgccctctcctgctgacagttgaaggcccagttccgccatcactacccttggaaagctgcttgcatctgctcccaagagagaagcctgcactacagtcctctctgtgtccttcactctgtaatcacgctataccacagtgacttccctggacctaccatgcaggtttacagctcgatagctctgctcatttgcttttgctcaacagctttgctcatttctgtttggaatgcttttctttcatcccttctccacctggaatagttgtattcatatatccaaggtggcccaactagtttgtctgtgaattttgtctgacctagaccagaaagaattactcacttcttcctctgggtctttgttcgacttcgtacttcacatttggctcttcctcctggtgtttgtgagttcttcatattagagatcattgcttatttcatcttcatctttactcagccaatacctaataatatgttgtaaacagtaagcactcaacacacaactgaagaaatgatgcattcagaactcaatacttttgatggcatagcttacaaccttagagaatagcagatcctgggaatttctgttggagacaagaacacaggcttcagagaaacatgcaattgattgacagcagggaagaaggcaggccacaggtgagatatgaagactaaaataagacagcaaccaggtgtgttttaatcaccaactcagcagagctcagaaggcctgagagcattgttgtatcacagaaatgtgtacgatgagttctgccaagtaaagattagtcattatgagaagctcaaattatgtcccatatccttttattaagaaatgtttaaaaattattttaggaaaaaaatttccaaaatcttagttactagtgtcctcagataagcaaaagaaaaccaaaagcataaaagcaacaaacaacaaaaaatctatctattcagtgcttctcattttcttaagatttcatcgtgaatatagctttataatgttgtaaaagtcaacaactttgaacaacatatattaacagtatacatttttattttaaatagtatatttctaatttatatttttatttttaaaagcatatagggagaggtgtcataattccaggtattatgctagcgcttcaaatatatgaaataaagctataaattttatttacattctacataccagaacaatcttaatgagtacttttgaacagctagggatgaataacataaaattaataagcccaaagtcctttcagtatcttcgcatgttgattgagcatgtatgttttagaatttaatgtattctggatgtgacttttgttttcatggaaatccagtagtccatgtctgcttcccagaacttttctgtccccatggtcaccatctctccactttcaagtatgacgctagacactactcttgtaacacataccacagatgagttatcctggtctcatctaaaagaaaaaaaaaacagcataaagaattctgagcaaaattcacttgctttaccaaataaaattgcatgttattctaaataaacctatataactttgaagatttcataaatacatgttaccaccacaaaataaataaatgtaatattgttaaaaagcatagacaagcatttggagccattttgacttttagaacagacagtatcttaagcacttgcttagcctagtaacctaggaacttccaggtccagtgtgtgggttagacaaaagccacatattctatggtgtcagaaggcaggtctcagtggcatcaggctcctgatagattctgaaaattattaatacgctgcattccagaaactgccaaagtattcttgatactctttgacatggcaaagatatatattttttcccaagttggcaactaattatttttatcatttttttggccgtgataatggcaatttagaaatcatgtgtttctaattgtaccattcaacaattgcggaggttatttttgcttggtcttcacagtgcaaacacacttgcctaatagtattgtagaatgaacactttttgagtaatgagttagcaattaataatgcaagcaagtcccatattatagagtcgacattaacatattatgcacttcctaacctggggaatgagtgctgatttgtttttcactgttgtctcgcaggcactgatcagcagagagtttgtcttacttaacttaaccctttaattcttagtattggtaaaaaagaaatagtctattccttactatcattggtttttggttcagagtccctgagaagagtgagatattatggttaatactttgaattaggcagaaaaaacatggctaaagatcactgaggcatcattcttattggcataatatatgcagaggcaaaacacaaatttagaaataaaaattagatttattttccaatatagaaaaatgtagttcttttacataactctgataaggctctatccaattcccttttttgcacttttctttcttttctcattgagagcaatgaaaattctagtttctctttttgaaacatttacaaattaaagatagtctaaggacaacatattttttatttttctatttttacactattacacattatataatgtgcatgtagtacacgttgtataatgtatacataacgtgtttatataatgtatattatatatagtatattgtacttggctctactatacttaaaggcaatgtatatgtgtatgtatattttttccaagtgaaagggcaccctggagtgtttttaatgccacatcacattcgcgtcagtggaagcttgagcagcagcctgtgaacagaatcaagcacagagtagagtttcttttgtgtgtgtgtgtgtgtgtgtgtgtgtcggagtcttgctctgtcgccaggctggagtgcagtggtgcaatctcggcttactgcaacctctgcctcccgggttcaagcgattcttgtgcctcagcctcttgagtagctgggactaaaggcgcccgccaccacgcccggctaatttttgtgtttttagtagggatggggtttcaccgtgttaaccaggatggtctcgatctgctgatccgccagactcggcctccgaaagggctgggattacaggcatgtgccaccatgcccggccagagtagagtttcttaaacaggaaagaaaacatcagaccactgtttcaaatacagtgcagagaggacagactggctgtactatctagaggaagagatagttctttatctctgtctttatgagatagttctttatctctgtctctagatagcatagccagtgtgtgctctctatactgtatttgaaactgtggtctgatgttttatttcctttttctttttggctagtatcagcatttaatggaatcctaaaagttactgtcttctgacggccattgagttgtaatcaacaccagcaatatatttcttctctatttaaatatatgcctaagaaaatgtttgatatcattttactagccatttaaaataagcccgtctttgaaaaattattatccactctagctagagggaagccagaggcattttagaatactgaacatgtattagattttgctttaccttgctccttttgttagttttctttttcctatgcttgcttaaatggtgctgcattcacgattcaggaaagtagctagttgatgttgctgggtatactttaaagtctacacacaatctccttctatcactggaagtgagtttaaaagtattcacacttcagtttttaaagggacaacagtttttacatttcaataaatttcataattttttatagttacagagttgtggaaaggcaaaatgttttaacaaaatggtacccacaagttcataatgtgaaaagtgcttgtgttagcatctactataaatgcaaagtcttaatgtttactttatgaagagtgtcataagtggagaaaatctcttaaccagtacctagtgaaggcatagttcataagacatagttctcttcagtaaatgagatcgtgatcatgagtctgagtacaattatttgtaagtaaagcttatttcttcttttacacatctaggaaaggttctgtatcaaaataaatttccttaggtgttagacacttggacaaggagaaattcatgtgtgcatatatatatacatatatgtacatatacatatgtatctacatatacatatatatgtacatatacatatatatccacatatacatgtacatatacatatatatccacatatacatgtatgtacatatacatatatatcaagaacttgatgctttgaaaagctcacagttttacagttgtgtaattatttttgcagagaaagtgagtaaaagaacattaagctcttcaaactatgcatcagttcccagtactcatttcagtgtaaaacaacagacaagtggagaaaactcattttttactgaaggaattacatacccttcaagtaagccataaaagctggttggctcacgatgggcagaaaaatcaatgtggaagaagagagcgcacctaatctattggcctctgtaggatattgtcatatataatagtaaaagcaatgtttcatggattaaaagagatgaaagcattcattcaaaattaactaaacttatttttaatgggtatctctattataactttttaggcgctcttatatagatgtaacctctcttacacagtacagattcatgcatgcaagttctcatttatttattcatcaaacaaagttaagcactcttatcaaatactatgccagatactggatagaaaaagttgaacacctgccatgatcctactgtgcgtgcagacctgtgtgcagaacagctgcagcccagtatcatcctggaggagcacagaaagtgccatggggaaccgcacagctattcatggaggatctctctcacaggcatgatgctttaaggaatatggtgtggcggtatttcatatacatgtgaataaaacaaaaagggattttagtgctgtgtttttatgatataaattactgagagggaacagtgtttatccaaaagtcctagagaaaataaagcatcaaaaaaaatgctaaaaaggttacgtccataaaaacattgatttttcctggaaaattgccaagctgtggctcatccagaaggaactaggtgtgatttttatcattaaaccagtaaatatcacagttatgaatttgaaacatgagcttaacaggttaagtctgtaacaggtttggtctgtgactttaacagtttatgtaacctttaaaatcaacactctgtgagagaaatctatctctacacaagcaattagtcactgccaatgggaattgcctggggaaaaattgggaatggctgatgggtactaaaatacagtcagaatgaataagaactagtacttggaagtgtaatagggtcaccatagttaacaataatttattatgtatttaaaaataaccaaaagagtggaattggcatgtttttaaacacaaagaaatggcaaatgcttgaggagatggatagccaattaccctgatctcatcattacacgttgtatgcttgtgtgaaaatatcatgtgtactccatgtatacgtacaaccattacatgcgcataataatgaaaaaggtaatgatgaaaatagtcattaaaagtttgaattaattttcaaattattttgctaatatattaaatcccacaaatcaataattttattgttacatataattttcccatcagcttacattttgtattgctgtttattccatctttacctgcatgctttcatctaatataatttttattcgacctgaaaaggactaaagagtatttactcagatttaatttaacttaaaatgtcttcaatttctataggatagtttcactttgtatagagctctatgttggtcatcattttattatagcactttaaagacagcattcattacctctggctttaatttttttccattgcaaaatcttctgtaacttttattgttgcttctttgccagtcctttttctatgattaaaatttttctctttgtaatttggtttctttcatctgaattctaccttttcacttctgctcaaagtctctaatcagttacagtaaattatctgtcattatctcttcaaatacttctttcattccattgtttcttttttctccttatgaggaaatgttatttattattttgcccatattccacgttttgtgacagtcattcttcatttactattagtttcgttatccctctttcaaaaattgtgtattaaccttttttctagttctctaatcctcttttcaactttgcctaatctgctattaattagcttaatttttaatttctgggactgcctatttcaactgcagaatttccatgtgactccagtctttgtagatggcagttctctgctgatgttctttatggtgctctttatttctttgaacatattaatcacagttattttaaaggcaacttctgctaactttaatatctacacttcctgttagtctctttctattgtactttttttttttttctcagtttttgatcacttggtcttttctcctggtatgctgggtaatttttttaaaatatagaatcttttgtatgaaaaattgtacaaataatttgagagtctggttgaggtttgatttccccagagaccatttattttgtttctggcaggcagttagactggggctgatctccttaatccagtctaaatttgagctgcttaatccaatccaatgcaatccacagttgatccaatctaaataaaagctggttttcttataggagaaactagaaaagcaccagagacaggtagcaatttttagaagcgggcctaacctcagagaggagaggtgagaggaagtttgtctggccggcattaggacccagagggcaagggtcaggatagataggatagatgggcaagtctggcttgggcgacatgcttttgagagttccggtcatggccacagggtcaaccaacatgttgttgggaccccggagctgcatggctttcctctctgtagaccctcggctcagcccagaagtacaggaaaagcggaagctggttctaggcaaaccaacggtcccaactccgaagagttgggggttgttagagagccctttcccagaaagcctgacacccgtttctttagtccggcggccacgctagtcgcttttaactggccgacaggtgcccggtatttagcccccgaattctaatgaaaaataggacagaatagcaagcgaaaggggtctgatgctactcactgcttggcgattggcgattgtctcactactcggcgataggcgacggtctcaccactcggcgattgtctcactgcttggcgataggtgaaagtcccttcgtggtcgccaaaatgtgtccggaattggtgggttcttggtctcactagcttcaagaatgatgccacggaccgtcgcagtgagtgttacagttcttaaggtggcgcgtctggagtttgttccttctgacgttcggatgtgttcagagtttcttccttctagtgggttcgtggtcttgctggctcaggagtgaaactgcagaccttcgtagtgagtgttatagctcttaaggcggcgcatctggagttgttcgttcctcccctcccggtgggcttgtggtctcgttggcttcaggagtgaagctgcagactttggcggtgagtgttacagctcataaaagcagtgtggacccaaagagtgagcagcagcaagatttattgcaaagagtgaaagaacaaagcttccacagtgtggaaggggacacgagtgggttgccactgctggctggggcagcctgcttttattctcttatctggccccacccacatcctgctgattgatagagcccagtggtctgttttgacagggtgctgactggtgtgtttacaatgcctgagctagatacaaaggttctccacgaccccatcagattagttagatacagagtgtggacacaaaggttctccaaggccccaccagagcagctagatacagtgtccattggtgcactcacaaaccttgaggtaaatacagggtgctgattggtgtgtttacaaaccttgagcaagatacagagtgtcgattggtgtatttacaatccctgagctagacataaaggttctccaaggccccatcagagcagctagatacagagtgtcgattggtgcactcacaaaccctgagctagacacagggtgctgattggtgtgtttacaaaccttgagctagatacagaatgccgattggtgtatttacaatccctgaggaagacacataaaggttctccaaggccccaccagactcaggagcgcagctggcttcactcggtgggtcccgcaccacggctgcaggtggagctgcctgccagtccctgtgccgtgtgcccgcattcctcagcccttgggtggtggatgggactgggtgccgtggagcagaggatggtgctcgttggggaggcttgggccgcacaggagcccatggagtgggtgggaggctcaggcacggcgggctgcaggtcctgagccctgccccgcgggaaggcagctaacgccgggtgagaagtcgagcacagcgccggtgggctggcactgctgggggattcagtacaccgtccgcagccactggcccgggtgctatgtccctcattgctcagggccggcagggccggccagctgctccgagtgtggggccagccaagcccacgcccacccggaactccagctggcccgcaagtgcctcgcacagccctggttcccactcgcgcctctccctccacacctccccgcaagctgagggagtgggctccggccttggccaactcagaaaagggctcccacagtgcagcggtgggccaaagggctcctcaagtgccaccaaagtgggagcccaggcagaggaggcgccgagagcgagcgagggctgggaggactgccagcctgctgtcacctctcactatgagggctggtgcatttccaggtgcatccttgctaatgtgtagcccttcagtgaccttcagctgtgggctttggagcttgctagagactgtcttccttcctgatctctcactcctgtgagactacaggacttagtttctccatttcctgcctggtgcctggaggaaagagtggatctgtattgggctcaccactctgtgttttctttctctccgttattctggctcctcaagttgttgcagccctgataatctctcctttgtcctcaaaacaattatgtttatcttgtaatatattttatcccgcttttctaatttggctctgcaggagacttggtctgataacaagctgttttatcttagccggaagatcatgtccgggaccattttttaggtcagccctttattattattgacagtaattctaagtgcttagtgggtgtcagatatatgacaaacctcatgtctgtcaattttcactacagacatgccagggaaggattattcctcatgtgctactcacaaagctcatcagttcagataataaaaacaaaacaaaccaaaaaaaaaaaagaggctcggaacgcagtgtcccatgactgcttctctctctgcgatgctgtttcatttcatcatcgtaggctactgagattttagccatcgtcgtttgtcttccatcaaatgcttccttagccccaactctttctttgacctgactgtactgtgagactcaagttgatggtggatgtaggggacaattcacagcagatctggaggaggtagaagagtccagagatttgggtcagtgctttgtgccctcccaggcttcctgactcatttgctcagagcctagcaatagccaataggcaattgtctgccaagatggtcttgttggtctgaggtgagggccctctgggaattctctggaagctgttaaaaccgacctgcttatgtgaccccaactgggagcatagacagattcaaatgaactcccctttccactaactttcttttaacactgaggaatcaattcctaaatatagtctcttctaaaatgtgtcttaatgatatattgagtattttttacaatgctggctaaaatgaatctgttatgtatttaaaataatgcatgcttctcaaaccctttttctacataagattatctcatattcaaaaacagttttcaaaatagaaaacaactgcttgctagatctgccaagctcaaaaagataaaaattggagtcatatcttaaacatataagttaaaaatgtacagtatatcgagaggtagtaagatttaattaaagtagtatatattcaacttaaaataattcattacttcctctgcatgtgtcttgttcttttttcttcatgaaataaacattttgaaatgcccaattattattaattttatatgaaacattcttttcattgccaaattagttttatcaacaagtcaactaaattctaaaatagaaatttgtgttcatagatggtatccttgactaaagattctttctaccgttcattttcagttaatattatttgaatgtttaccttaaaatgtagtcatgtaaactagtttcatatgcagtctttgctccatggattgatttacctagccatgaccacatgtctgttacatgtgaggcactggaataaggactgaggtggacaatcgttgtctatcttttcacctaaaagtgatgtaaaaatgtgcattgaacttccgatgatgtcaaacacaatagcagggaaaaatgcaataaattatttgcattccgtgaatttacaatccagtatgaagcgggcagtatgtacaagatacaactttttaagataggatataattaacactatcataaggaaataaaatgttaggagaacctcaaagggagagagattgatttggggtgatttaatcaggaagggcttcctggtgttgtcgcatttaccttggaagacgcggtgcattttgctcagccagggtagaagagaatgtcttatgtgatgccacgaagaagaaggaggggagagagcagttatgggtgagatggaagaggagaaaggaggagcctcatgagacgcccgacatggggaacaactcaagctgggaacccgacggcccgagccagaacctcatgatattaggaaatttccataacttcgctatgcctcaattttctcacctgtaaagtggatgcaatagttttttttatgcttttaatatcattatttgtgttacacgatacacaacaaaggaagatggtcaacactgcgatgaaaatgttaaaaagatatatgatacagggctcatgtctttcatgtaccttcctggaaataaattaatgagcatggagacacctggctgggtgatgaccacagccgagagcagagggcgtgttaaggcagtacccacaaggggaagggcagcagggggcaagctcaggctagattccatgaagtttacataacagttgaaagcagtgcctggtacagtcagggccacataggtgtttaatacattttaaagacaaaatatttagtcctcccaccctctttaaatatagaaacaaaagcagagaaacacactcatgtaggttggtcacagttactactataaagatgtgacagttcacatggaaatggtagtatttaagaaaataaaaagcaagtagggatttggaaatgtaaacataaaatacaggaaatcgagctatgcatctggagttaaagacttaattatacccttataagacttaggaaaactaggtaaagttttacacttgggaaatgtttatctgagaattgaatcctagaatttaacagaaacatggaacacaagtaagccaataatggaaataaaattggaaattcacctgtaaaaattcaccatgtaaatttacatggaaattcaccatgtaaaaaacatggagtttccagaatattttgcttcagaagtatccttaaaatataggtttaaggccgggcatgatggctcacacctgtaatatcagaactttgggaggccaaggttggtggatcatgaggtgaggatctcgagaccagcctggctaacatgctgagaccccatctctactaaaaatacaaaaaattagctgggcgtggtggcgggtgcctgtaatcccagctacttaagaggctaagggaggcaggagaattacttgaacctgggaggcggaggttgcactgagctgagatcacgccattgtacaccagcctggaggatgagagcaaaattctgtcaaacatacacaaacacacacacacacgtgtgtgtatatatatatgtatgtatgtatgtttaaacttcaccattggcaagaggattttttatatatatacatatatatatgtatatatatgtatgtatgtttaaacttcgccgttggcatgaggattattttcctgattccgtcagagcaaccacacctgactttttaaattcttagtgtgtacatattcctcacaggccactttttcattctgcaattactgctcttcctgcatgttttattgtccttactctttataaactgtataaatggaacagtttattgcagaaagatatcttttgcagtgtctaacattgtgcctttatgtgataaacatttatgtacaattttcaatttaattaatgaaaagatgctgtttaaaaaggttaatcattttaattaaatgtattgatttaatatttttccacatggtggttttcacatggtgatttcaaaataatgatctagtaaaatgtgccttctataatgccgccatttctgcttgtaaagataggtttgttttttttttttttttgaggtggagtctatctctgtcacccaggctagagtgcagtggcacgatttcagctcactgcaacctccccctcccaggttcaagcaattatcttgcctcagcctcttgagtagctggaattacaggacctgccaccatgtccagctaatttttgtatttttggtagagatggggtttcaccatgttggccaggctgatcttgaactcctgacctcgtgaaccgcccaccttggcctcccaaaatgccgagattacaggcatgaagcattgcacccagccaaagataggttttataataaaacaggaaattaatactctgaatatttgtggaaggatttatgtttatttaattcacagtgaagaatatgatgtagtcccttgctgaggtgggcgaatcatgagatcaggagatcgagaacatcctggctaacacggtgaaaccccgtctgtcctaaaaaaaaaaaaaaaaaaaaaaaaaaaatgagccgggtgtcgtggcaggtgcctgtaatcccagctactctactcgggaggctgaggcaggagaatggcgtgaacccgggaggcagagcttgcagtgagccgagatcacgccactgcactccagcgtgggcaacagagcgagacttcctctcaaaaaagaacaaaaaatgctcttttatcagcctgtggtaagatgtgggggactttgagtatagattaaaattgctagaagcagctctgagctaactcgggtgcacttgcacagtcaactttttacacacattaatgagtacacagtcctaaagccgagccctgggtccaccaaatatgtgatccccgaaagtccaaaatttacatagaaaccagacccatgtcatttttctctggccatccaatatcataattgcactaaggcttgtttcctaggacttgatacatttactatatatttagttattaaatatatattcacttgaggtctgctatgtgccagggaaaatgcaaggccaaggaatgtagctctaaatcaggtatcttttttattctcaatgagctttcagttaaggacaggcagataaagtaatcaaacagcatacccatgaaaacactgtgttagggtgcaagggcactttgaaggagcaatttgtcctctcttagcattcaggggaagctttcatagagaaactgaagtgttgaggtgtgaagagtaagacttacctggtgaagaagagatactggatcctgcctgagggaaaagcaatttcacacccggaggaaggatgccgtgggccacactggagcctgtggatgggctgtggatggcaaggtgggtgctgtggtggcatagggaagaggaaggaggggagcacgcttggagctgggagcctgttgggttcctgagagcagagtgtccaagaacatttccccgacttgagaggatggaaagaaatgtgccacaggtttagaaggtaattctgaaataagctctcctaaatattttggggcatcattattgaaataattttagtctcccaagagagcagctatgaagtcagcccatctgaggagcttcacagactgctaagtgaatttttttcctttcttacattctatatttgattttgatacattcaaaagaaaatctcgcttcaataaatgtattaaaaatcagtgcaaaaaaaacccaaggaaacattgcagaagattagcataaattatacacgttatatatgtgtgtgtatatacaaattatcatataatcatttttggcctgttcgtaatcaaagcaatattaaagaaataaaaattcaagatctaatatctgtcaccatggagatagaatcacactgtgttcatcgaattagaaaacttagctgagagcttggaggatttctacataagtaaatctaaataatcattctattaattcctggaaaaattatttaatcataactgaagtatgtgactaaagcatttgtggaaatgtacatgaaattaaaatagtttgttttaagtattaatatttaaattatttttggtaaatatcttaatatcacttgaattagcatacatattgatattaacatatatttctgaaaatttagttaagttttagaaagagattatcagacttctagctacttatgactgaaggctattattttacattgttttcatgtatccaaaaatatttatttaataaatgctatatatatacagagtaagctagatactggatggacaataacccaacgccacaccccaccccctgccaacaaaaaaggtgagagacagtccttgctatcttggtatagtaggagagagttacttattagaaactgtatgtgaaaaaatatataccttccagccaaacgaaggactattaaggaaaaactgtaagaggattttgcaagaagaggtaatctagtctggggaatgggacaggggaaggtcttggccaaatgcctctgactctcccctgaagagtgagcaggagagaagccaggagaaaagaaaagaatgagaggagaacccaggcaatgccctgtggcaagaggaagccttgtgcttttgtagaggaactagaagggtgcctggaattcagaagacgaggtggggactggagtagtgtagcctacagagctgatacagcttagtgcacataactcgacagtcctgcatactttctgcaattattctaagagggataggctagcaataaagaggaggttgaatggtcaattatgctggcatgtggagcactggtgagagaagagtggatgttgaaagataatgcagtaaataattgtatttttccacccaagagatcacggcagcttggactgaggctgtggtggtggaggtggatttacgagtttgatttggtgatgtgctgtgggattgtttgatttacactggaacgatcacaacagctgtaacacggggaatgaatgacagcaagtttgcaagtctttagaaggcgactgagatgatctagtctaaggacattgcgacctcagactagcttgttattgccggagatgagaccagcaattgttgataagcacttgtggagtatgagagaagaaaatcaagaatacttctcttggtcatgtaaatttattaacatattttaaatcttcaaaatgttgcctgtatttagacaattttattcctttgtataggcaaggggaactggagttcaaatgcactgagccacatgtctaccatatcataatgaattcacagtggacacaactttctgtctcaaagtgagtttgatggccaagaggtgctctcccttctgcactctggtgatgcctctggaggatacctgcattattccttttcttcagataacgttcagagaaattaatgacctgccggatgttacacagacaatatgtagtggaaatggttctacaacccaggacttaaatttctaaaatccagcttccttttcatcccgcaactttaataaaaatgtgacctgttattgccactttgcagaatcacattattacataaaaaggacagggacaccaatcatatatgaaaataatgagaatgatctccaccttttaattgtaaaaggagacagtaactgtatttttaggagaattatagtaaccttggaagaggtcaagtgataagatacagttcttggccacagtgctatagagactgcaaaaatatttattgaatgaaagaatgaactatgcaccttacatgttagtgcattttggctggattctattttatagtaaattacaagtatacttttaaaaaacctggttttccaggggccctttctccttttatttactgaggaagcacaatattaaaaccgaatttcacctgaatttcatagaggtcattaggaatagttcttgatctaaaagatattaaaacaaaattatatgtgtgtatgttattctttcacaaagaaagtctatttaaattaaattttggacgaagaagcacttgaatcatgaaagatttttgttgttttagttttgttttgatattggatggcaaatgcagaaactatgagtgttgctttcattgtgcttcatcagtacacctcatgataaaggtgtgtgtctatggttagttttgaaaagaagacagttttccccacatatctggaagagagcgtatagctaattcaaagattcagaattctttaagtgtctcccattaatgtattcatggacacataaattgagacacacaaagcagttggaactcagcaagatgaccgaataggaacagctcccgtctgcagctcccagtgagaccatcacagaaggcgggtgatttctgcatttccctctgaggtacatggatcatttcactgggactggttagaaagtaggtgcagcccacggagggtaagcagaagaagggtggggcattgcctcaccggggaagtgcaaggggctgggtaaccccctctcctagccaagggaagccgtgaaggactacgccgttgagggatggtgctatccagcccagatagcatgcttttcccacagtttctgcatccaacaaaccaggaaattccctcagatgcctacaccaccagggccctgggtttcaaggaaaaaactcggcagctgttcagacagataccgagctagctgcaagaggttttttttggaccccagcgtctcctggaaccccaacgagacagaactgttcactcccctggaaagggggctgaagccagggagccaagtggtcttgctcagtgggtcccacccccatggagtccagcaagctaagattcactggctgggaattctggctgccagcacagcagtctgaagtcgagctgggagacttgagcttggtggagagagggatgtctgccattactgaggcttgagtaggtggtttccccctcacagtgtaaacatagctgccaggaagtttgaactgggcagaacgcaccactgcacggcaaagccactgtagccagactgcttctctagattcctcctccctaggcaggtcatccctgaaagaaaggcagcagccccagtcagcggctcatagataaaattcctgtctccctgggacagagcacctgggggaaggagtggctgtgggtgcagcttcagcagacctaactctttctgcctgctggctctgaagacagcagcagatctcctaccacagcactcaagctctgctaagggaaagaccgccccctcaagtgggaccctgacccccatacctcctgactgggagacacctcccagcagggatcaacagacatctcatacaggagagctccggatggcatctctcaggtgcccttctgggacaaagcttccagaggaagacacaggcagcaatctttgctgttctgcagcctccactggtgacaccccaggaaagagggtctggagtggacctccagcaaactccagcagacctgcagaagaggggcctgactgttagaaggaaaactaacaagcagagaggaatagcgtcaacattaacaaaaaggatgcccatgcgaaaatcccatccaaaggtcatcagcataaaagatcaaaggtagataaatccacaaagatgaggaaaaaccagcacaaaaatgctgaaaattccaaaaaccagaatgcctcttctcctccaaaggatcacaactccttgccagcaagggaacacaacgggacagggaatgcgtttgatgaattgacagaagtaggcttcagaaggtgggtaataacaaactcctctgagctaaaggagcgttttctaacccaatacaaggaagataagaaccttgataaaagattacaggaactgctcacttgaataactagtttagagaagaacataaatgacctgatggagctgaaaaacacggcacaaggacttcatgacgcatacacaagtatcagtagccgaattgatcaagcggaagaaaggatatcagcgattgaagatcaacttaatgaaataaagcatgaagacaagattagagaaaaaagaatgaaaggaaagaatagagcttccaagaaatatgggactgtgtgaaaataccaaatctatgattgattgatggacctgaaagtgacggggagaatggaaccaagttggaaaacactcttcaggatattatccaggagatcttcctcactctagcaagacaggccaacattcaaattcaggaaatacagagaacaccgctcagatactccttgagaagagcaaccccaagacacataatcatcgcattcaccaaggttgaaacacaggaaaaaatgctaagggcagctagagagaaaggttgggttacccacaaaggcaagcccgtcagactaacagtggatctctctgcagaaaccctactagccagaagagagtgggggccaatattcaacattcttgaagaaaagtattttcaacccagaatttcatgtccagccaaactaagcttcataagcgaaggagaaataaaatcctccatagaaaagcaaattctgggggattttgtcaccactaggcctgccttataagagctcctgaaggaagcactaaatatggaaaggaaaaactggtaccagccactgctcaaacataccaaaatgtaaagaccaacaacactatgaagaaactgcatcaactattgtgcaaaataaccagatagcaccatgatgacaggttcgaattcacacataacaatattaaccttaaatttaaatgggctaaatgccccaattaaaagacacagactggaaaattgaataaagagtcaagacccatcggtgtgctgtattcaggagactcatgtgcgaagacacacataggctccaaataaagggatgggggaatatttaccaagtaaatggaaagcaaaaaataagcatgggttgcaatcctagtctctgataaaacagactttaaaccaacaaagatccaaaaagacaagggcattacataatggtaaagggatcaatgcaagaagagttaacaatcctaaatatatatgcacccaatatagaagcccccagattcggaaagcaagttcttagagacgtacaaagagacttagactcccacacaataatagtgggagagtttaacacccactgtcaatactagacagatcaaagagacagaaaattaacaaagatattcaggacttgaactcagtggacctagtacatctatagaactgtccacccgaaattaacagagttcacattcttctcagcaccacatagcacttattctaaaatggaccacataattggaaataaaacactcctcagcaaatgtaaaggaacataaatcataacaaacagtctctcagaccacagtgcaatcaaattagaactcaggattaagaaactcactcaaaactgcatcaactacatggaaactgataacctgctcctaaatgaccactgggtaaataacgaaattaaggcagaaataaataagttctttgaaaccagtgagaacaaagacacaatgtaccagaatctctgggacacggctaaagcagtgttctgagggaaaatcatagtgctaaattctcacatgagaaagcaggaaagatccaaaatcgatgccctaacatcacaactgaaagaactagagaagcaagagcaaacaaattcaaacctagcagaagacaagaaataactaagatcagagcagaactgaaggagatagagacatgaaaatcccttcaaaacctcagtgaatccaggagctgatattctgaaatgattaacaaattgatagactgctagccagactaataaagaagaagaagagagaagaatcaaatagacatgataaaaaaaagataaagggatatcaccaccaatcccacagaaatacaaagtaccaccacagaatactataaatacctctatacaaataaactagaaaatctagaagaaatggacaaattcctgggtacacatactctcccaagactaaaccaggaagaagccgaatcccgaaatagaccaataacaagttccaaaattgacacagtgattaatagcctaccaaacaataaaagcccaggacagacagattcacagccgaattctacaagaggtgcaaagaggagcttgtaccattccttctgaaactattccaaacagtagaaaaagagggaatcctccttaactcattttatgaggccagcatcatccaaataccaaaacctggcagagacacaataaaaaaagaaaatttcaggcctataggcctaatatgcccgatgaacatcgatgtgaaaatcctcaataaaatactggcaaatcaaatccagcagcacatcataagcttatccaacatgatccagtcagcttcatccctgggatgcaaggctagctcaaaatacacaaatcaataggcgtaatccatcacataaacagaaccagtgacaaaagccacatgattatcccgatagatgcagacagggccttcgataaaattcaacatcccttcatgctaaaaataataaactaggtattgacggaacatatgtcaaaataataagagctgtgtatgacaaacccacagccaatgtcatacagaatggtcaaaagctggaagcattgcgttttaaaaccagcaaaagacaaggatgccctctctcaccactgctattcaacgtagtgttggaaattctggccagggcaatcaggcaagagaaagaaagaaagagtattcaattaggaagagaggaagtcaagttgtctctgtttgcagacgacgtgattgtatatttagaaaaccccattgtctcagtccaaaaagtccttaagctgataaggaacttcagcaaagtctcaggatacaaaatcaatgtgcaaaaatcacaagcattcctatacaccaacaatagacagagagccaaatcataagtgaacacccactcacaattgctacaaagagaataaaatatctaggaatacaacttacaagtgatgtgaaggacttcttcaaggagaactacaaatcagtgctcaaggaaataaaagaggacacaaacaaatggaaagaaaaattccatgctcatggatagaaagaatcaatattgtgaaaatggccatactgcccaaagtaatatatagattcaatgctattcccatcaagctaccattgactttgttcacagaattagaaaaaaactaaaggtcatgtggaaccaaaaaagagcccgtatagctaagacaatcctaagcaaaaagaacaaagctggaggcgtcatactacctgacttcaaactatattacaagacaagagtaactgaaacagcatggtactggtaccaaaacagatatagagaccaatggaacagaacagaggcctcagaaataacaccacacatctacaaccatctgatgtttgacaaacctgacaaaaacaagcaatggggaaaggatttcctatttaatacatggtgttgggaaagctgactagccatatgcagaaaactgtaactggatcacttcgttacaccttatacaaaaattaactcaagatggattaaagacttaaatgttagacctaaaaccataaaaaccctagaagaaaacctaggcaataccattcaggacataggcatgggcaaagacttcatgactaaaacaccaaaagaaatggcaacaaaagccagaattgacagatggaatctaattgaaataaagagcttctgcacagcaaacaaacaaacaaacaaaactatcatcacagtgaacagtgaacagtgaacaggcaacctacagaatgggagaaaattttgtcaatctatccatctgacaaagagttaatctaatatccagaatttataaggaacttaaacaaatttacaagaaaaaacccatcaaaaagcgggtgaaggatatgaacagacacttctcaaaagaagacatttatgctgccaaaaacatatgaaaaaaaggatcatcatcactagtcattagagaaatgcaaatcaaaaccactatgagataccatctcatgccagttagaatgaccatcattaaaaagtcaggaaataacagatgctggagaggttatggagaattaggagcgcttttacactgttggtgggagtgtaaattagttcaaccattgtggaagacagtgtggcaattcctaaaggatctagaaccagaaataccatttgacccagcaatccctttactgggtatatacccataggattatacatctttctattatgaagatgcatgcacacgtatgtgtattgcagcaccatttagtatagaaaaaccttggaatcaacccaaatgcccatcaatgatagactggataaagaaaatgtggcatatatacaccatggaatactatgcagccataaaaaaagaatgagttcatgtcatttgcaaggacatgggtgaagctggaaaccattctcagtaaagacacagaaacagaaaacgaaacaacgcatgttctcagtcataagtgggaatggaacaatgagaacacagggacacagggacacatcatagacgggcctttcgggtggtggggtaaggggagggatagcatagcattaggggaaatccctaatgtaaatgatgtgttgttgggtgcagtaaacatgtatacccatgtgtcaaactggcactttctgcacatgtatcccataacttatatatttttttaaaaagacacacaaagcatcttagatgtgaatgtgcttttgaatatgagtattttatttttattcttgcattaaccaagcattcacattttacagtatcagtccacatgcaataagcacattttagaatgggctctgatccagccctgtgaaaatcactgatactcaaagttaaataacagtccttgtgctgtaagaatctctgttacgtggacagaaagtgcaatttcaggtcattgattaagtgaactcattaaaaaatgaaaagactaaatattcttactcagcatgcttatgtagagtctgaattaataagaaatattcattagctcatgctgcctcactttttttttcctttctggtatacgataattttatgaccagcaatagtttaatataagtgcaatgtagatagcatatatcagtaagtaacattggaattggcccagctataatgtattgtgaaaatcagcatctgggcagaagaaccttcgtcctttattgggagaaaggaggagcatcatctcataataattgcacagagcactctttctgtggggttttcaagctcaattttgtgactaattcagacacttaatgaagaaataaaggtctgttttcacagtctacctgcgatttctaagttggagtgggaagaagtagtacattggaattgctcttttcttcctccttccaagaaaagagacgaggtaggaaaaaaatgccatttgttgttgttttctccacagctgcaccattgtgtctaattcctggtgcaacagaggtctcttccaagtgcatgtttcacttgttcttgtttgttttgcttacttttaataaacattattgggttttacaagctctgagaaataacacaatcgttacaattgtagtgaatgaaaccattcattcactcacttatattcaatccccactgttcatgctctgtgacataaaccaaataaatgctaccataaaagtaatgttgtaaacattcatggaatactctgagtagggctgtgatgctgtgatttattttcaaagccatacattttaaaatacagattaataaatttaagctatttatggaagcccccttttcaaatacttctccgtaggacgccagttaataccttgaaaaatacatacaggatttcattggagaaagtgatgttttctccagagactgctaaagtctcgattgctagagttattttaaagttttagttcattcctgaattgactttttctcattgctggaaaacattcagccaagtcaatattttttaaagaaaagatggagctatatcttcatacagtaaggcccagataactttgctgaaacaatttgcaaacaaacatacgattttattcattaaaataaattttgttatataaagtgcacattccacctcaaatatttgaaactgtttgtatatatgtattccaaaattataccaaaactagctttcttttttttttttttttttttttttttgagtcagagtctccctctgtcacccaggctggagtgcagtggtgcgatctcagctcactgcaagctccacctcctgggttcacgccactctcctgcctcagcctcccgagtaggtgggactgcaggcgcccgccaccacgcccggctaattttttgtatttttagtagagacggggtttcaccttgttagccaggatggtctcgttctcttgacctcgtgatcaacccacctcggcctcccaaagtgatgggattacaggcatgagccaccacgcccggccaactaaatttcttataaaccattttcatggactcttgtcatacatttaataatgagccaatggctttcctttctaaatgtattttgtcaataacttactagatggtgccaggtaccagtgttttagtgaaattttcatagctacattgttgaatgtatacattttgactagcatggtctattgtagatggatcaatctcatcattcagtgctgatagcaagatgcattcttatcttcacatcatgtgatgtatattcctggaaagtacaattctggataactgcattgaggaagaacagagttaatatatctcataggcaaaataccttataagaggtttcgctaaagttatatgtaaaatagaattaataaacaatagttcaatagacccaaatatagattatactgagaataataggaaatagtaaatggaaataatttttcactcattgaaacaaaaacattatttctatgaggaaaatttaatatttctttcaacagaagaagaaaatctggaatgactaaatttgtgtgtgtgtgcgtgtctgtgtgtatataatatatatatgtatacatatatatatatatatatatatatatatatatatatatatatatatatgtatatattttttttaaggtggagtgttgcgctgtcacccaggctggagtgcaatggcacaatcccagctcactgcaacctctgcctccttggttcaaacggttctcctgcttcagcctcctgagtagctgggactacaggtgcctgtaagcacacccagctaatttttgtattttttgtagagacagggtttcaccatgttggccaggcttgtctcaaacacctgaccttgtgatcgcccaccttgacctccttaagtgctgggattacaggtgtgagccactatgcctgggctaaaatctatattttacttgaaaaaattgctattgaattattccactgcaatgtaaaatgaagaggttaagtgtgggcataccacagctgcacatggcttgttacaagccatttttaggcagactggttagccatcactgcctaagactgatttagaaatttacagttacacttgttcactcaatattctgcacactattgtgaatgaggcattcttaatccaatttcccttgaagttattacatagaacataaataagaaaagctattgttattgtttttcatcattggaaagtcaaatcagtctgaggctgagtgataagaagctgtacttctaataaaagtgagaagattcttgggtagaaagcactcagggaaagtttttcttcagtgtttatcttaaatctaggccttgaaatccattttgttgaagatgacagacatctatcattacagtaactccaagggttccccatgccaaggcacccacattcttttgagcacaaaaattcataacactagaaaagccgctattaactatatcatagagaaatgggtgaattaagctacgtaaacaaacaagacacagaaaaaatagtaagcagcaaagtaaatgctggacgcatcccacagtgagtgaaaaagctaaatattttaaattctaggtgcttgttctagtgatttcttttttgatgacagtcattatgctccatgttcagatccatcaaaatgccctcactattatcagggtatgcattcattgttagcttactcaggtactatagactttagaattatctgcttcctcagtgaagtgtcagattagtttatgtgacaaaacttaactgttacctggatttgcttacttttctctgtattgattatcagtatttatgcttataaaatttggaatgcttctgtttcgaacatcgagtcacaattataatagataaagtatgtcatggaatgaatgtgtgtccctgaaccaggatcaggcccctcaccagacactagatcccctggcaccttgatcttgaatttccactgtccagaacagtgagcaacacatatttgtggtttaattcaaccaatctatgttatttttcttatagcagcctagacagacaaaataaaatatataaaatgttatctgcttgtatgctaattaaaatttgagcagatttaaaaattataaaactgttatctgtaaggatattgtgcttgttttccttgtgcatgtccaggggaaggaagtgaagaaaaatatttgaaagctcaacaatgacttgaccattatcttctgaaccttttatacgtgttcattttatagaatataaatattggaagaccattatctcatcaatttatttaaatatgcttatgacatacttaagatatgctaggaatgttcgctaactgggcttccatgagttgcaactccatgggcgtaactcctcattttcctgggaatctgcagatgttcaacagctaaaacaatatatttagtcttctgctggaatttattctgtggaactgtgctacagaagaaacattttaaataaagtgacacttcttttgttacttcgcaactccaagtcttctcagcagatatcctagatattcttatacttaggaacattgaggacagggccacacattggggacagaaacatttaggacagggcttgcaccgatggtctagtcatgttaacatgtcaacaggtcacattttctacagttgcaatttgcatattaaagaaggaggaatttcctttaaattttgtaatgtgtaaagttttacatcacttttaggttttatgttttaaggaaggaaggttttaattgttttaaagagatgtgtcattgtcttcaactcatttataaggaaagcactacagttggagtgaggatgtgtggtgaggagtatcagtgcgtggggcagggcaggtatagccggcacaggaatactgaacgggagagcctgtgccttggcattgttgaatgtgagatgatcattgttttaattttattttattattgttattattattttgtagagacagagtgtcgctctgttacccaggctggagtgcagcggcacgatctgagctcactgaaagctctatctcctgggttcacgccattctcctgcttcagcctcccaagtagctgggactacaggtgcccgccaccatgtccggctaattttttgtatttttagtagagacggggtttcaccgtgttagccaggatggtctcaatctcctgacctcgtgatccgcctgcctcggcctccgaaagtgctgagattacaggcatgagtcactgtgcccggcccattgtttttattttttaggagattccagaaacccagattcatatgagaaatctcccaaatttggagttggttaatacaaataaaacactgtttaaaacaccggaattttcatggtgcatgtgagtgctaccatacctacaggatagattttgcttacctgtgacaacttctgtttaagaaagtagagttaatttttttatatatacatttatttttattatgaaggaaaggaggttacttactaaggtttttgtgggtattttggaggcatttgaattcttcctgatattctaacataataaatgatctgctgtatttatttatatgatataccttttaggatatatattcttgactctgctaacagccaccagcatgcatctgtctgaaggtcagtgtaggatttctggctgatggtgttctgggcctgaacaccagtggcgtgacttgctcttgagttggatctccatagaatctgacatttctgatgtgtcctaaatttctgaaatttaaatttttaaagatattatttcagtagtcaggatatgctcatttttgttccatttcatgtatacttatttaataactaaagttatcttttcttactgactccaggtttgttttacgactgataagatttctaatgaattcaatctctacagtttgagttgaattataacttcaacttcttctgattaaagaattaaaataatttactaatttgagggctaggttcatgcctcagtcttttgggctctggtgtgccacttcttccatttcccatttcttgggggcctcccactgaccttgctgagtcctccactccagcaggttgtcctctctctgctcgcgtaatgatgcctgtgtatttcccgtgtggaacaccggtgtgtcgtttcttccaggacttggctcaagtgtctgtttctagtttcttcctactgctcatgcttccttgtatgttttctgctcttaattaacgatacctgcagcttttcctacactcttccctcctctatcagggaacatatttccatcttcttcatgtaattgacgtctctttgctggctgcattgaatatgtacggccttccttttctatttatttattttctgtgattttaaagcttccttaactctcttcgtttaccggatgggcgttgtgaggggctggcagtgtctaaacgcctggcctttgtggatgaactgctttggttgagattctggcttcatgacatatgcgctgtgtggctttgaacaagtcactgtgtttctctgggactccatcccctcagcagtcaacaggtatgttcataacctctgcctcatcaagtcaaatgagagatcacaggtaaagtgtctgcaaaataataagctttcagtgatgttctctttttcttttactttcttttctctctgtctctctttttttcttcttttaacagagtctcactgtgtcatccaggctggattgcagtagctcattcatggctcactgcggcctcaatctcctgggctcaagggatcctcccacttcagcctcctgagtagctggggctactggtgcatgccaccatggctggctaatttttctgttttggtagagacagggtttcaccatgttgcccagggtggtcctgaactcccggactcaagtgcttcacctgcatcagcctaccaaagtgctgagattacaggcatgagccactgtgcctggccagaattttttttgttttgttttgtttttgagatggagtctcattctgtcaccgggctggagtgcagtggcatgatctcgattcactgcaacctccagctcctgagttcaaacgattcccctgcctcagcctcccaggtagctgggattacaggcacacactaccacgcctgactgtttgtttttttgtattttagcagagatggggtttcaccaggttggccaggatggtcttgatctcctgacctcatgatccacctgccttggcctctcaaattactggaattacagatgtgagccactgcacctggtcgatgttttcatttaataatatcattttattgttatcatttgtaattcctgtggattggtatgggttgaatatatactacacacaaagcactgtgtaagacttgggaaatatttagaacagtggaagacttaatctttgtccatagaaaatgtaatagagaaaacggatctttgataagtgaacctgtttgagtcctaggaggaagagacaccactgtgggatttgatgtccaagagatttgctggtgaacatctcttgtgaaggacagaagaggaacaggcagaatcattaggaagtcttcaggctacagtgcaggtgcagcactctgaagaataggaggaaggaaagatgggaaccgaagagtctcaaaccacagtgttgtcgactaacaaaaaatgaaatcttgcttgtaaagagttaaggttgttttattcagaagtcttgctgaggactgtcacatgaggactaaaccgtgggagaaggctttcagggaggctctgccataccgctccagcacagtgttttagctcacactgtatctacaggtagcagaggtttccatgcatgcaaaatcatgttaaagtttgggtgtcagaggatattcagttataggttactaaaatacatttggttatagattgcagaagcataattgctaagcccatcagacatgatcttttgtgtaggaaaaggcaaggactaggaacatttatctttcaggaagaaatataatgactcaggcaacacatgtaggagaccacgtgctgtatcctgttttgtcttcaaaacaactttctagagaactgcacatcgtcacatagtcaggggctttgtgaaattactttggcaggaaatgagcaaacatggcttcttagctttgctgctgctgcttcttgcagcatggaactgagaaagtgcggtgagatgagcgcggttttctcagcatatgctgcttcctggagcagcttggagggtgcagtcaccacgtggaggtggcccaagcacgaggcctctgtggatatgcagtcgaggaccccaagggtggcaggtggaggctgtctgtcaactgcatttctgaccacagtttctcttgaagcacagccaggaggtgcacatttatgaccacagcgtgtgattacagggatggctggtgttttatgatcaggaaacccagggtcatgagaaacccaagttacccaaagaggctctagaacgttttcctggagaaggggcatgaagtggagaaaggtaagatgaatagaatttcacgaagtgaacatgagatgacgtgtgtctcaggtggaaaatgcaccaggctgcactgataacaactgactcactatttgtgaaataacagaaagactgatggagctgctacgcagcatctttgctgtttagcaattttactgaccttcaggtataggttacataaatatgaattattaataattttattatatgcttggttatagaggttataattttatacaacattggggtaattatgtaagttcctatggatgacttacacacacaacaaaagtgaatatcagtttccaagaacttaatatgaaccctcgtctctcacctttctaaaggaattttatctcttacttttctactccatggttatatattttaaccccttctttattcataaagcctccaaatgccatggttcagtgtatttggtgaaatagtatatgaagattttttttaatattttataacataaccagagagtggaaacagaaaactgaaaattaaatcatctgtaattccataattcaactctaaactgttattatttacacatttaagtttggacttttgttttcattttaagtttatccaacattttaagtttatccaacttaaagtcataagagactaaagccagcatatgctcataagttgacaataatacaaagaccagatcttgattccaagcaagggcctatttgcgtatttaaccccagtgaagtataaacatgcagcagcagagttttcactgttcataactgcttaaatacaagatgagggctccaaagggggactttgcaaagaactctacgatgaatgtacaatcaagaaacaatactgccttaagccagttcagtcagggaaagtatcaaatacaggaggtcagaaaaaaaaacatgatcagttgaaatctctattttttgttttgttttgatttgatttatttatttatttattttgagacggagtctcactttgttgcccagtctggagtgcagtggcacgatctccattcactgcaacgtccacctcctgggttcaagcaattctcctgcctcagcctccggagtagctgggattacaggcgccaccaccatgctgggctaatttttttgtatttttagtagaggcggagtttcaccatgttggccagcctggtctagaactcctgacctcagatgatccagctgcctcagcctcccaaagtgctgggattacaggtgtgagccatgtgtctggccaaagtctctattgtttattagggactagtgtttgagcaaggtacttgctttcggagtcttcctgtcttaagctcagtggaatcccatgagaataattgtacttacctgttactttgaagtcaaactgcaaccctcacttaagctgattattaggttaaaaaatactttgttagagttaaaaaagattattaatttgaaaaatacgttttagtgatggtgcttcataatataatactacggagagttttaaatcataaaaaagtgaagaatcaagtggttaagtggaaatcttccaaaagtgtatattctgtgtgtttgtggaagtggatactcaccagggctttcttatctttactgactaaagtgataaggggacacattacatcacatcctgctcttgtttagatgcttttgtagttactcttttcccacagattaacttcttattatgatttttaaggtcctgggtgccttggccatttacatttcagtaaatgtttgtggaattgattgattcatcgctgagtcagtatgacataaggcattgttagccatagctcagtggtctgtattttgggtcagtcaaaggcagctggtcactgtagtaaaaataaggccaccttattatttatcagcttcctgaaaaatatgcatagcctaagatatgatgaaaaactaaaaactgaacacgtcatctttacactgtccgactcccatttcatttataaaaagagtgtgactctgatgtagagctatgaaacgtaacgagaaatgaaaagaaatctaacctgaacgtggggcacggagacttacgtgccatcttaatgctgtcaaacacctttgaaattgaccctttgctgtatagaaatttattaaatctgacctttttccttccttctattcctttcttccttgcttcctttctttcttatttccatccttcctttctgttctgggatactgctgtcccccttcccccacctccccaaaacacacacacattttaagtatcttaatactgttgtttttctgccttcattctcacgttgttaaagatgtattttatttctcaactgataatatttcttcagtcatttaaatgatagaatcaatgtgcttttaaaaatgtatttcatctcatttcaaaaaaaaaaaacctcgcagattttcagatggattactatgctgtgaattcttagataatgctatcaaattatatcttggcatatcaaggcatctgctagattttcattttcctcttttcagttagaacctagtgattttctttgatagaaatatagaccaatttgatgcctttagcttgtaagagctaagaaattctaggaatagcactgagggtagctgtctggtagcaggtttgaactcagcctcgaatccgtcaccaaattctaactgatggagctaagcaggaaggaaaagcaaaattaacctttacaaatcacccaggatatggcagagattgcattttgacagcattttataaagtatgtttcatgacccataagtgattgttaaaaaatcctttataaaaattacacttgaaaaatgttgcttaatctcaattttagaaattcagaatgcacattagcttacataaagaagcataaagcagatacaggttgaatatcacttatctgaaatgctggggcaagaattatttcataaattttgattttgcagggagtttggaatcattgcattatacgtattagttacacatcccaaatcctaagtgctccaatgagtgtttgatttgagctttatgtcagcactcagaaagtttgggtgttttggatcattttggatttgaggttttcgactttgcgatgctcatcttgtgaatattttgtggcaatgtgtttccgctaattaaacttatggaaaaaaacttttgttgtttgcattgcactatcactatcctattaaacactttatgggaaaaaatgaacaggattattttaccatatactattcgtttattctttgctatttagacaagtaggtattattttctctgttgtaccgagaaggaactgaggttgagagataattcgattattcggggtgctgctcgagactttcctcatgagactgtagcaagcaatatgagcacagtgtggatgcgatatgtcctctgtaccctggcctctccgtgtagtcttgccagcttacaatgctcttaaaattgttatacagttatttttggacatcttcataaccttaaacattatttaaaataggtattctatactattttacaattaaaatttatgaaaatggtcaagattaattttaaaagaaccataaaataactttcattttcctgggagaaatcctaacttttctgatataaagtatccccataataaaatgttgtcgtaaattcaaaagaattaatacaaaaattggatctatgcatagcatacttattaaatcttaatgtctgcgttattttgtttttccatttgatgcaaacattccctaagtaaattcgagaaatttaaactaaaataattatattttatttaattcattgagtataagggaagcatttagaggttcaaaaatatacttacagaaaatcaatcattttatatagaaaaagaaattcacttcctaaagtaaggaactgttgaaaagtttcttcatattttacacagtaaagatacacttgactttttttaaagaaagtcttttcagtcttttagatataattttcgtattttataactctggcttaaagtatattaaaagctaataggttttctaattttctttcaatctcagtattattttgcatttgttaactgaaatggaactttcttatggtttccctgaaagggtgcaggctcctgtgaagaatctcacccctaaagagacttattcctctccattgctgattgaattctgacaaaagcagcatttttatcatgaagaattaaaacactccatagagatataagctgctgaaacccaaagtgaggtatcaatgatccttcctggaggcaattgtaacaggaaaaaggaactgggatgcagatggagagtagaaaaccaagtggccaggcaggaaggctagcttcacctgtttcagaatcgccccctgatttgtgaggtccttgacaacagcatgtccaaatctggtctccatgcacctgcgctggagaggaaacccaaatggcccacgacattccccgtccctcccatgttccatccattgccaggtccatttgttttttccttctgagcatctcccaaacatgccactgcacctgtcttttttctggcatcttccctgaccgaacagccatctcctctcagatttctgcaataacccgtaagctggtcttcctgcattcattcttattcctaccaatctgccatctgaagtcagaatgatcttttcaaatgtaaaagtgatcatatttcacatcgattgaaacctttcaaaaagcatcctatcattcctaaaaataaatagctaaattcctgccatggcctacttggaattgcgtgggctggctcctaccagcatctctgagtcttacttgcgtgctctccttctggctctgtgttcctcaggggccctggtggcccctccagcaggcttggcttactccatcccacaggaattcgttgcctagaagacagcatcccacatccatgaacaccatcatcaccacctgggcctggcaaccttctatttatcttcagcttttaaccccatcaatgcttactcagaaaatactggactgcctcaacagggacggacgctgctggctcatgggtttccctggccaatgactagcactcaataaagttcgaatacatcactacaatagtaaaacttgcaaacctaatttttaggtatttatgatgattcttatcacattgtttaatatttatggtaaatgttgcctatggcaacttagcaataaggtaaaatcaacacatcctgagaacggtgtatgatatttaaatgtcatatacagcttcgctcttaacttccatacaactcaactattatcactccagtaatttctataaagccacaaattaaacaggaaatttgttccagattctcaaattattacgtgaacattctaatgttaaaaagtgactgtgtctgggcgcggtggcctgttcacgcctgttatcgtagcactttgggaggccgaggcaggtagatcacctgaggtcaggagtttcagaccagcgtgggcaacatggtgaaaccctgtctctactgaaaatatgaaaattagccgggcatcgtgacgcatgcctgtagtctcagctactcaggaggctgagtcaggagaatcacttgaacccgggaagcataggttgcagtgagccgagatttctccactgcactccagcctgggcgacagatcgagactctgcctcaaaaaaataaataaatcgcgattgtttccacaagtgactaatataataaatatgttgaatttacacacaatattaaaaacctgaagtttggtactgacgagacagcagggatataatgtggaacactgggcggttagatcgcaaggtctactaagctttggccagactgtctcatgccagcagacatcagcgtgacaggctaaatggactccttcacattgaggtcaattccagctgaaccagtcatcagattttttgtgcttgttttaggcagcttgttttggtttatgctaacccagtcctgtgtcttcccagctaacccaatcatgtcccttgtaaatagatgatccagaagtcttttcatggcagacataggacgattacacgttactctgagcagttagaaatattctgtacactaatagcattgccatgaggcacaattaacgtcactctagaatcctaaaaatagtgggaaatgtgctgaagatagttatgatctcactgatgcttttcatgctatattggtagagctaagctggtttctaaagtgctagatcaaaaataatctaatttagaatgtttaatgtgttcttaaatatgatagctaaaaaaatcacataaagaacatcaaaactctttttaagcagtctctccctcctttatttttgaataaaatggtttgctttcatttgtaaaaaaaaaaaaaaaaaaattctttttcagtttataaatgcctgtcaggagtaattaatgaaaataatacaaaatgaagccttataaatgtttataaatgcctgtcaggagtaattaatgaaaattacacaaaatgaagcacttttacccagagctgatatatgaaatcttagtctttggagtgaagtggaatgaggaactgttacatttatgatggttgcagactgtccagattttagagctgagttccacagacacacatgtgaaacatgggaaagggaggcgacaactgaaaacgtacaaagcaacagtgaggtgttcacaaggtacggggctcataggtacctcgaaaactatctttgaaagaagtaattggtacctagagagtggtgttattttaacattttgaaaatgtgagcttattattaacgtgcttcatgttctgactcggtgaaatgtcaccaagcagccagcatacataagcaaggtacaagagagcagaaagagacgggagggaaggcctggcccttctggggaataggaacttgccatctcacctgttcctagggaagaggtttaaaagaagagcttctcagctagattttcacaaacatccagctagagcataattgcagtgggctatcctgtgaaggaggtggggttaggtgtgtaaagcactttaccacccttctgagatgactgttcaaacgatgcctatctagtttcactttaaattttaaagcttctgagcatcttgtgatggggtaatagacccatctcattaagatcgattgctaggcttggtacctcagaaaacagctttcattttttttttccccaattgaaactcactgtgattccagaagtccatttcaggagaaccggatgcccaagatactagtgcttcccagggaatggaaagctgacttcattaatcttctccagagttctgcatatatctgggcagaaatttcccacccaataaatctgttcttggtactatttctacaccttcacattgttgaaccaataggagatgggaatggatgcaagtctttgagacaggattcgggatttgagtaggctcttccttaaagttcacagaagccaaaagaaaaaaaaaagaatgtgagatttgagtgtagggatatgcataacgtttcagggaaggattttcccaggtccttctgaagcagaaacacagcagatgagttactaaccttgaaagggaggctcacattgagaccaagctacatagaatagcatgctttgtatcttaagattaaaaaacaaatgatgtttaaaatcccaatgcatgttagattttgtgccttctaagacaccccattaatgtcagtgctagcatatgtcagttccttatttcattcaattgacaataatttgattagtaattttgaaattaaactgttaaagctacttctagatcttttagtttgctaaagaatgtgaccagctaggagcagtggctcatgcctgtagtcccagcattttgggaggtcaaggtgggcagattgcttgagtccagaagtttgagtctgcctgagcaacatggtgataccccatctctacaaaaaaaaaaaaaatacaaaaaattagccatgtgtagtggcataagccaggtatcccagctactagggaggctgaggtgggaggatcatttcagcctgagaggttgcagtgagctatgattgtaccactggactccagcctggactccagcctgggagatagagcaagaccctgtctcaaaaaataaataaataaataaattgatcctgagaagtgttgggaccaacattgtcctgtatgttaaactgagaagcctggatttgatggcagcatcttgagtgtggggtgacatggtggtgcctggaacctgcagagagtcagccagggaagaccatagggatggttgggcaggtagcattcaatttcaagttgtttttctgcaaactaaaatatcaccatcaggtcaaatccttcgtgaagaatgagaggatctaagtgaaaacaaaagaaaggacagtagtccgcatggggtttggtggggaggagaattaagggtagtggatgaaatggtgtacacagcacaccaaaggcactcacagccgggggaccatgagaagacaagagattgggtttcacatacagccttgagtcagttggattttaactataaaaagatagcctgcctctgcattcgaggattttcagtattacaggagggttggtggagctggtggacatttctgagctgagtccgtggaaggtaagatacacaggatctccacatagatgttgccagacccaggtcagtgtctctttaggtaattataaccacattttattttaaaacattcaaaatagtgaatctagttttgagaatttgttgtcaaggactacttcaaaaggcaggattttataaatcctgatattaatttgggcagcctttgtttggtgtatttctttttaatgaattcgttgaaatgctcatagtcagatactcaggaaactaacttgagccaagtcctgggtctccgttttctagtatgtaaaatgataggatcaaagtatttcaaggagagcaaatagttttccatttctgtgtcgacttggaccaattggtggtggtttgtagagcactgtgttgataaagatgattaaactgcctccgggctcagaagaaaaagttgttaagattgattttaaacatgtgacactgtggactggataatagacaaggtgagttaggagagtatatttgtcacctttgtctaggtaaactgttagagatccttttaaatcccaacatctatgatttcattacctatttaaaaatcacctgcttttgtgttttctggtttttaaaaaatgtttcaaaaaataaactttatcctgcaaaaataggagtttttggttaacagcttccgcacagttaaagatagagaataagctgatgtatcaaagtgacctaaaaatgcaatacctttagtttacagtttttttaatagccaagaaatgagtcatctaagctagtggtgatgttcagctttctatgccatctagggaccgggtttgtgtgtgtgtgtgtgtgtgtgtgtgtgtgtgcgtgtgtgtatgcttcttccaatgaaatgtgttgtattcctcatgatcaaagttggccgtgaaaccacaaccatggaaatgagaagcaaaagtgaaggctgagaaatgtgctttcaagaggtacagggaaagttgcacacagcacatcccatgaacttcttttgctgagaccttcgtcatgtggccacaccaagcagaaaaggagaactggggaaaagtccgtttctaccgagcaacccacgcctatccaaacatgggggtgttccaattctgaggatgacaaaaaggaatgctgcagccacttttctcctccactcttgtccttgattaacagaaatgtgactcaaaagttaccattttaagagaatgttgaaaatggccattcacctaagtaatgtcttttcttttcttttttttttttttttttttttttgagacaaagtcttagattgtcactctggctggagtgcagtggcaagatcttggctcattgcaacctctgcctcctgggctgaagcgattctcctgcctcagcctcccaagtagctaggattacaagtgtcaaccaccacacccagctaatttttgtatttatagatttatagtagagacggggttttgccatgttgcccaggctggtcttgaactcctgaactcaagtgatcttcctgcctcagcctcccaaggtgctgggattaccggtgtgagccaccgcgcccggccattcatgtctttgttgatccaagagtgccagcatcacgtaatgcgggaggctgtgcacatgactgtctttcttgggtagggaggaattgcaaaattatctgtaggttaaagagttattggaagactgggaatcagtggaaacctatttaacagagtcaattaaaaaagcaaaagaagatggatagaaataaatcacaattagaaaactgttactgtgttttgtttaggttaaccaatataccccattattagagagtcatttttcttgtttctggaataatttcttttacccttttccttcccctcgcattccaagtcacctgggtgtttggtcttccgttataatttctttggcattctggaatatggtagggttgataacattacattgctgccaatggagtgatttccagaaatcaagtcagctgagaggaatcccttgagtcagtctgtgtaagaaagacaattggggcaagatgctatttttttaatgaccacttttcttaagtcaaacttatggaagtttaatgaagttaatgaagttaaaaacattaaatgaatgtgaaaagtcaacaaaatatacttaattactcataatctgataaacttggaaataaaaaaatacaattgcgtctcaaaactttatgcaaaattaacttagatagatcaaatatggaggtaagagaaatttccaaggtaacaggattctaaatgtattttaaggtacagagaaatactttacctcctgcgcgcatcacatgtccccccaagaccaaggcagtatgctctccatatatcaggttgttgcatggtttcccgtgaactaacaggaaggcacctgggaatgcagctgctttcaaagcggttctgtaattaccttgacaactggagatcagttaaaaaagagaaatgctttgtagacaggtagatggaaaatcaaacacctaattgtgatgatttttgaaatcattctgtggggaaaaaaagccatttgcatctattactaatcaaatcatatttaattatatatttaaaaagaaaagcttgtgcattgaattcagtgtgacatgaaaggcattcattttttatttttgcatggcattttcattctgagggcttatgtcttgctttatatgaatgcaattacattgatttcatatttatatgaaagtcaggaatgttatagcataacaaagaaatagactatgcgtctaaatatacaacatgaatattcaatgaacgacaaaatacgatagagtatttgcttcttggggtgatattattaaaataaaaatgagacttatacatgactaaattaaaaagtgaacttttttcgatagttttcataaagataacttcatttttgcactcaacgtacattttttattaaatgccaatttttgacggcgctatgttaggcccaacataagctcttgtaggagtctccaatcctagacattcggtaccatccaaaacagtatcatcatcaaagcaaataaactatgagaacaagctgtaattccttctttacactgtgccttttatttaatatattgcaagggttggctgtaacccacaatgttttttaaagggagtactggattgcttgggagtgcctggcctacatttgctcaataaatgtaattacccttcttttgttttccagacccaaaacaaagttgttttctcggcctttattttgtcatggctgaattattgctcagatttcttctgggatatcccgtccaatccccgtgcaacaacaacaaaacctaaccattcttgtttctctctgccacattaacactctattttcttgaacattaaatttccagggtacaagagttttcattcaaaattccttgtatcagaatcatctgcttatagcttctactccagataagagactttttaatttaccatttctcatacagaactcaatcattcgttttacattcattgagtataatgtttaagtctttttaattgtggaaaaacagtaaagaatgacacaggcattacttgagagatagatgatggtttatccaagtatctacgaacaggtaaatacagtgagagcagagtgtgcatagggacctggtagaaaaaaagaggccagaaatgtgggctgctgcatataatgaaagtttctttttttctttttcaatctgatgctaggaagttgtattttcttctaaaatccactcacaaatataaaagaagaaagtaatattttcagatacgtgttttagaaagttcactgctgtggcaacgtggaaaattgattggaaaattcaagcctagttataatgcctttacatttagtaatctgaaagatggcaacacccagactcagcagccgcaggaaggaaaccacagaggcagaacccaggcttgctggataacgggggcctagtttaataagtggacgggttgggatagagacagaaaacagcaggtctgatgaaataatttagaaacaggtctgggggatgcatatattgaattttaggtgactatgaaatatacaaatagacaagtccaaaaggtagttggatgtatgaatttggagctcaaagaagatgtctgggtatgaattatagataaggatgtagggcacacagggtgatgcctacttcatgtacgtgaatgaggctatcctgtaggggcagaggagaatcaacatctcagggatggtgtgttagggatctccagagagagacaactagcagtgtacagataggatatacatatatatgcatatgttgtattatatacaaatattataattataaatataactatgcatatatttttatatattatatgtagcatgtataatttatatgcatacacatatatatttattatgggaattgacttagctatgattatgaaggcggagacgtctcatgatctgctatctacaggctggagatccaggaaagccattggcgtaactcagccaaggccaaagtcctgagagcaagaagagttagtggtcaaagtcctgtcctgaatctgaaggcctgagaaccagaagtgctgatgtactagggtaggagaagatggaggtcccagctctggaaaagagaaaattcaccgtttatcttttgttctttgtggcctgccatgggttggtcggtgcccgtggaatggtaagggtggttcttcactcagtctgccgattcaaactctaatatcttctagaaaccccctcacagacacactcagaagcaatcttttaccagctatctgggcaacccttaccccagtgaagttgacacagaaaatttaccatcataaatggccggagaggaaaagacagaaaagaacatggaaaggaccctccagagggaaagaagtggtgggagcaggggcttgtggtcttgtgcgaccagggccaaggcccgtagatataacaaggacataataaactgaaaaatgttcattggattttgattctagaagcctctgatgagctgaagaaagtttcagtagaaatctttccatttatacctgggtgagggtgtctgatgaagttgacttgcaggtggtaagtggagggaagctgaaaagtctctgtagatgcagctgtggatggaatgcagtagaagggggtcataagaaggggattcaggcgacatgggagaaagtttctttctgagaaagaataggcaagaatgtgattagatgatggagaaaagagagaactaaatgtaaaatataggggatagaggacacctgatgaaatgatcttcctagaaactgtctcctgtgtggcctagatgatgagctagtttgctctgcaatggattttaacatggtgcatgattccaggtacagatgcgtttttccatggatgcctgtgaaagtgaggaatttgctatccgttggcatcagctttaacagagaaaatagtgagcatgtctcactgcacactgggaaactcctagggtgtcttactcctagccacgaaccagccaaccactttttctctagccagggcttctgttgccagtatcactgtgacccaaagaacctttcatttttgtgttacatttttatatatgtagattctttcgtagggtcgtgagatctacccactagtttatttttaaagatatattgaaaagtaggtaaacgagcccttcctatttttacctctctcctaatatgtaggactcttattaatcaaggcagacgttgagtgttcattgattgaaaactccatatttggaggagaataaaacgaaagaataataaatatttatgaagggcttttctggtgttagaaactgttgagtcattttgcaacaagtatttcatctttcattgagaaagcactgtgaagtaactatacattactgcacctcccattttatgactaagaaaatgcaaattccattgttcaggttctcatagctgtttctcacaaatatgatttttaagaaaggtctgtttcactttaaaacctgtgctctttccaagttactatgtcccctcttaacatgccttttatatacatcatacacacatatgtgtgcacacacacgtatattgtttaaatgggtgcatgcattcagatacgtgcgtgataaatatagagtaaaatgcattacgaatatgcttatagacaacaagtgacatattatgtttttaaacttctcaaatatatttctgaatttcaatgtaagtggaacattaaagaccaatgtgatggagaagattccttgctgcttattcaattccagttccctatttttggaagcagtgaagcattaatgtgttacaggtagctaattcaggtttttggtctataagtgaacagcagtgctgcccttcaaaaatggatttgctctgacactgtaacattgacccatgcctgagaatgaattttcaaggatacattgtaatacaccctggcttaaagctggacatggaatacgttaatgcatcttaccaactatagttaaattgtattattttatttatagttgaagatttgtgtatatttttaagattaatatataaatttttccttctgtgtcctctaaagccttataagtaatttttaaaagtcagcagtggatcccaatgtaacatatattagctaaaataaaagtcaatttttatgtaacgttacaaggaaagagtaaactacatataactattacaaaattttataactactgtaatttttattaataaaagtaacaatagattttttaaaagaaaaactttgattcaataacaactggacatctacctaccaaaattaaataaataaatttagatattgacaatagacctcttacaaacagtaactaaaaatggctcatagacctaaatatgaaatgcgagactatataaccacacaaggatgacaaaggaggaaactcagatggctttaggtttggcaatggtttttacatacaacatcaaaggtgtgatccatgaaaaaatcatttaagttggactttatgcaaattaagaaccctaagaaagacaatgttaaaagaataaaaggcaagccacagactgggaaaagtaattgcaaaaacggatttctgataaagggcctgtgtccgaaaatatataattaaatgtaaaactcaatagaaaacaatgaacctaataaatgggctaaagaccttaacagacacctcaccaaagatgataaacagatgtcaaattatcatatgaaaaggcgctccacatcttatgtccctaaggaattgcaaattgaaacaataatcagataccaccacattcctagtagaatggttaaaattcaaaatgttgacatcaaatgctggtgagaatatgaatccactggaactctcagtcattagcggtgggaatgcaaaatggtacagcccgtttggaagacactttggtgtgggtttttttttttttttttttttttttttttcaaaattaaacgtgtccttcccatatgatccagccatcataggtatctactgaaatgaattgaaacttatgttcatacaaaaacctgtgcatgaacgtttatagtcaaaactggaagcatccaatatgtgtttcggttggtgaatgtataaactgtggtccatacagataatcaaaattattcagggctaaagggaaacaattaattcatgcaagggcatggaggaaacttaactgcacaatgctaagtaaaataagccaatctgaaaaggctacaaactgtataattccagatatatgacattctggaaaaggcagaactatggggacgctaaaaggatgggtggttgccagggggtggaggaagggagggatgaacaggtgaagctttggggatctttagggcagtccacaccgtcagatgtgattctgtaatggtggatgcatgactttgtacatttggcaaaacttacacagctgtataacacaaagaaatagaatgtcaataatggacttgaatcaataatgtatcagtattcatcaattgtaataaatgtgccacactaatgcaggatgttgataatagggaaaactatgggaggcatgtgaggggtatatatgaaatcttatttctgctacattttaccatcaccttaaacctactctaaaatatagactatcaatttgtaaaacactggttataaattgcaaatatgccatgattataactgtatggaggcaggtgccctgaagaaacattagataaatattcaaaaatgctaatatatttctattagagtgatagaaatatactgtgaaaaaaacttttttctttatttacaaatatttaataatataatcatgttatatttcttgaatattttaaaatatgtatggctaccatatgtttactttgtactttcacttatttttttcatgaccatccattgaattatatgttccctaatttaaatagattcaaactatcttctgccgcataagatacagtggtgatatagtctgttaatctccattctcttgcattggagcaaagtgaagaagttacattgaaaaaaattgcgttagcaataacataaaatactgggcaaaaatgacagcacccttttatcttctaatttgcaacagcattcataaaggaggcttcaataattgtgcttttttaaaaaattgatttggtgatctattcaaatatcccattgttctcagaactgtgttctataaaacgtcagtgtctagtgagatttttaatggttattcttctgaagagaaaacttaaaaattaaaactttttttttgttagtaagtttgtatcttttattttctgttatggagaacgacaatttatattaacatattcatgggttttgttgactgtgtttatcctaatatttcaaaaaaaaggtattttaacttgattctttcttccatgaaacaagttgtgccatatttttattcagaaagtttgaggaagacttagaactaagagttctaagaatgtggattcagtatagtgtttacttgcccaaactgttgagttcattgtccagaaatgagcatatatttcacttggtaagaagctagagggcgcccattgcacacggggacttcaggctctgggaccacatttgcttcaattggcaacagagtgtggctcacagcatttcttcctccacatctgaggtcagtcaggcctcatctggaaattcatcgcctgccaacattcatcctatagaaatggacagagtgcagctacaggtgcggcgcctccagcctccatcccttccctggcatttcatattgctgactgtacagttttgtcaggatttattgagaattccacttattattattatttttggtcaagcatggtgatataagagtgattctttttttctttatcttatttatttatttatttagacagggtctcactctgtcacccaggctggaatgcagtggtaagatcttggcttactgcaacctcagcctccttggttcaagtcagcctcctgagtagttgggattacaggtgcttgccaccatgcccggctaatttttgcatttttagtacagacagggttttaccatggtggccaggctgttcttgaactcctgacctcaagcaataggcccagttcagcctcccaaagtgtggggattacaggtgtgagccacgacgcctaccgatttttgataacgtgggacaccttgatccaagtggagcccacttagaagtgcaaaggtgaaggcagtgcttacaaaataagcaaaactataaaaacactttaacacattaaaatcttcaaaggcagtacccactgtaattgctgtaagaactgcatgggggtagttatgatcagcacgtgccagtagatcctggggatgagagagacgaactggctcactctaagtcacacagtagttactggcaaagcagagatgggacttccagtccctagatgcagctggaaattcatgaaattgagccctggcaccactattggcttaaattggtggtaaaaaaatcagttctcataattctcaactctccagacaatagcattttggggaaacacaaaaatgtccttagagtttctaacaatcgagtttgtgaaacattttgctaagtaaaatgaggcatttaaagagtttgagcttttcatgtttcagaccctttacctgtgctattaaccctattgtatgcaagaatcatagctgttcagtttagtctacagcctcataaaattaaatagcagactagcagagtggcggagagtcagacttcctgtgttgctggtttgggtgagcctttacctttttttgcctcagttttatcatctgtaaaatggggataataacagaaggtacctcactggtccgggatgattaaggtaagtggacagcccttagtacctggcacagcttagacacttggtaagcatccgcagttacagtgaactcaggattattccaagaagcctttcctgacctttgtacactgttaggtgctcccatgtctggcccctctcaaggtttattttcacttctgttatagtgcttattatctttaattaaaataatctgttttcatttctttcccatccattaggttttcagatgaggtctcgctctgttgcccaggctggtctggaactcctgggctcaagccattctcctgcctcagcctcccctaagtcctggaattacaggcatgagccactgcacccggcctgaggttttgagattttcgcggttgttgttattttttaattttcatgcttatttcaccagttttgggggaacaggtggtgtttggttgcatggaaaagttttttagtggtgatttctgaaattttggtgagatgtttatgggcagaaatctttccttattttacttcttgctggaatctaccacattatctgagcaaaccagcagcagtttaaagcaaatcccagcccctcctgtcaaacttcattcctaacttgagtccatcatgctttacattgcacgccaaccactttcggtgtttatatattcatagggcttatatatggtgtcacgataatcgtattgaaaataatatgacagaaagaagccgggggaggttcagcttgctgcttggcgagtgaggaggggaagagggccccggtgagcggctcaatagccatgggcatctgcaggcagcacctggacggggcggagtttgggctggggtagatgggaagagaaatccagccctgagatttccgcacacccaacctctctggggttcctgtcttgaggcagaaggtgacccagaaaagagtttgggaaaactatttcatacacataatgcttaacccatatggaaaataaaccagattaaaactatcagaaagtattgtattctaagtgactaaagataaaacattttgtttccgtaaaatcacaataattcaaggatagagctaggatattttcccctactataatcttaataaacaatattctcagttattttaccatttaaatttgcagtccacctgtggtacatcaaactcttttttcctaagtcccttttaacattataagccagtgtaacatgagaaaaatgttggaagtttgctaaatatgttaactcattctgtaaggctaatgaaatattagaggattttgggggaaagatatttgcttatatttttttcacacaatttcaaagatgagtttttgaagactgactaaaaatgtaatgccatcataaatgaaatgatgattctgtgggaacactccaaaaacattcctgctgatccatgggcttagtgaaagagattgggaagtctatttagactgaaaatgtcttaaaagatatattttacatcccacatatgcatactatcttccagaaatactgcatatgaaagctgaatgcaatatttagtgtctgctgacttgtggcagtggcaaacctcaaatacagtaatactgcaaaataattcaaattgtgtgttaattcacccacaaaaaaatccatttttagctttttccacagaatatgctaagctaaaggtcattatgtaacatttctaaaaagaaaaacaaaagccacacatttttctggcacctaacactggcaatggaggataacgttgcctgacaagggagtaggttattttatttattttggctgagattagaactgaagccagaattagcattttgctgaaaaaataaagctttctgcattcaatatgggcttttagattcaaagattccataaaaggggaactttggtaagcaagaactgtacatttgagaaatcagttttaccttctcaccagctttgtgacccaaaacaagttacttctttgagcttctgtttccttatctgtaaaatgggtaaacactaacttcatcaaatcccttcatcaaataatttggaggtttacttgctaggatgtatgacaagtgtcttatccaggttggtactacattttattttattatatttcatttcatttcatttttttttgagatggagtcttcctttgtggtccatactggagtacagtggtgcgatctcggctcactgcaacgtccaactcctgggttcaagcgattctcctgcctcagcctcccaagtaggtgggattacaggcacctgccaccacacacagctaatttttctatttttagtagagacagggtttcaccatgtcgaccaggctggtctcaaactcctgatctcaggtgatctccctgcctcggcctcccaaagtgcttggattacaggcataagccatcgcacccagccttttaaaaaaaaaagttagacctgaagagaaaatatgaactctggagaagttataatatttgcaatgtcgtagtggtaggataacaaaataaatgcagaagagggattagaaaaatataagggtgccacatacatcaaggcagtaaatagcaggcaaaaaaaaaaaaaatgtagccacctccagttgcatgttacaccggagtcatggtatacctgtgccaaatgacatcacaggctctggtctattttatttgaggttttattgatacctagcaagaaaatgtctccagaattattggagagatgaagcaattgacagctatatttatactcagttatgtgattcagatgaaaaccatgacgcagagcatggtgtctggttttgagtacagctgttaaaagcaaattggtttgtcagagccagttaatgaagttaatgcttttctcacaaagagagaataactaatgagaaaataagcattctaaatcctatgtgatcaaagcaatgcaaaaagtgctgcttctgctggatcttacgcagctctgttggataaacacggccctgagagtcagcaacggctgcatgcctggtgattcgaggccaggtaggtcttccactgcgtattcccgtggcttcgctgggggaagccatgcttttgtctgagcacaccctgatggagtcttcgaggaagaatgaaagtaatgcaaatcaatgcttaatttgaaatgtttatagaatagtgtcagataacagtaggtccgagaaaagcccaggccacgaaatgttcagcaagttttcaacttgaaaactaatctttttaatcagagtcaattaaaactagtctgtaataacatacagttccaaattctggaatatatgactattagccttatagcaattagtaatatgacttttaataacaataacaataataggaataatcacaaaacagaaaagctatatgcaatattacattgccctacagaattagcacaactttctttatataataatctctcattttagcatttattaagtcgcatctttaacagcatttataaaaagataagcattttaccagatggataatttatttctaaaaatacctactgtattttgtcagtttcctctaaatcaaatattttaaattatatttccctttaatgctgatatataaatagtagtctcatgacagaaaagtacaagaggacccaaattgtaatacagttttacatataaatgcatatttgaaaatagttcacatttccctattttgatagaattttctgtctttgattgtctaagcaggtttaaataacccactattgatgtttaatataagaccgtgctcaaatttgtatgatatgttaagagaaatgaaaatgataatcatgatatgccatttctcatttttccaataagtaacattttacatttttacacagttttacaatttctccctgagagtctggagaaactggcactctgatgcactattgtgcaaaatgcaaaaggtgacaccccttgtgaaaggaaatttggccgcatgttaataaaatgatacaggtgctatgatctgacacagcagataagttccaggaatctattcaaaaatatatgctgttgaaagtaaaagtggcatatactcaaaactttttattctggcattagtacaaataaaagtataaataaataacaaagtacaaataaaggaataaataaataacctgtacctattctcagtatccacttgtgcagccactaaacggcaggatatccacaacagtgtccgatgctgctgtaagaaggagaatgcaatatctctgtatacaatatcatgacatgtgagatttgttaagagaaaaagacaaggtagagaaagtacaagaaggatgcacctaggctgaaacttcacgtatacaaatggctgagagtatccatacctatatgtatatatatgattaaatttaaaattgtaaggataaatttaaaaaatacaagcaaataaatattacacacaggaaatgggaagttgtgtgtgctgaaaacagggagaaaactagattttttttaatagaacatgtttgtagattttatttaaaatatgtgtatatggtttcacataattatgaataggttaaaatgaaatgcaaaagcatcgttaaaaatttgcagtcaaataaaacaaatctccttacttactgagttgcggtttatatatacagaaaggaaccttgtcaagtgaatcttgaacatggtaatcagatttactgacttagtggggcacgccctatgaaaacactgaggaaattttcagctgttttcaaaaataatgttaataatggtggcattgatattctgaaacttttatttattttaagataaaacaaataattacatcaacattgttaagatctaagtttctcaattcttattataaacatcaacaacaaagagttaattataaaagtaaagaagtaaaagctcagtaaccctaagtttgaattggaagcaggagtgtgaactcacgatgtatttcctttaaagaaagggaaaatatttttatagctccactgaaaagtcctagaagcatgaactaacctattaacaatgagtactactgcgatcatttagattattgtctccaaataccttattgtaaataaagagatcagggctcctcagaaaatggctgaatcaaggtctttggcaaatcatgaacagaatgatttggaactatattataatttcacagaacagagatgctatcttggatgacttagggttaacctacgagtaacttggagagctcttactgttacaagataaaaaatttgaacatcgaaagaatgataatggcaatggattgaaacacatatacttcatcaaaatctttaagtttataatgattgcaaagcaaatctacaagcagataagcaaatgaattctattgttcatccttggaagacgctacaaaagtaacttgttattctaaaaatagcaataaataaactaaaataagatactttctctataactacatattatttttcagataacaaataattgacttccccctgtgattttggttaaaattaaattcatttaaattatttaaaaattgttaaaatgtagttattgactatgttattgatatttcaagcagttctttatataccttatatagattatactgcattatataattttcaaagttgttatatatgggagattatgtttttaatattgtatcttctaccctagtcctataagagagaaaacacataaagaaataaattggccaggcgtggtggctcacgcctgtaatcccagcactttgggaggctgaggcaggcagatcacgaggtcaggaaatcgagaccatcctggctaacatggggaaaccccgtctctattaaaaatacagaaataagccgggcgtggtggcaggcacctgtagtcccagctacttgggaggctgaggcaggagagtgacatgaacccgggaggcggagcttgcatcgagctgagatcacactactgcactccagcctgggcaacggagcaagactccacctcaaaaaaaggaaagaaagaaagaaagaaattgtacgtggatggagttggaggtcataatcctaagcaagctaacacagggaccgaataccaaataccacatgttctcacttataactgggaactaaacactgagcacacatggccataaaaatgggaaaattagacatttcaggctactagaatggggaaagagggaggaggggaggggttgaaaaactacctattgggtactatgcttaccacctggatccaatatacccatgtaacaatcctacacctgtaccccgctgtatctgaaataaaaggcaacatttaaaacaataacaaaaatattaatgagttgtaaatactctggcaagagagtaaaggtgaatgagtgaaaacaagtttcaattgataaaccatccatgcaaaggcagaggtttatagcaaaaattgcttcaaagtaagccagagagtagggaagaaaaggaaagccatatgagtcgggctggcctccttgagcatccttgggcgtccttcagcatccttggggccaggcccacgcagaaggtatttctttctgagatagcaggtgtgctctattaaattgtgctccctagcgaatgctttctcttttctgatgatatcagctcaaaagttctgacaaatgccattaagatagcttaagattgtgtacatgtgtacataatctgttgagataattgtgtccttacatatgcctgaattacaatatctataaattggaagactgttctgtttatccacaaatgttatacctatagactgacaaatctgccctcttgtagtgtattttatatttatatatataaatatgtatattatatattaatatatgtgtatgtatattatattctagctattgaattacatatatttatttatacacatacatacactccaaaagggcagatttgtcactttataggcataaaactttatataaatataaaatatagaagcacagaaaaattacagtgtacttttattaaaatactcccactgtaatactattgctaattccattgtatttttaggtttttctctctgtgagtcatttgtaaactttttgatgatgtttttaaaaatcttcagtttgcaatgacatcgttttggggtctgccagatcttcatcattagtgggttattttcttgtttaacatcctcttctcggattggttaataatttaggtaaactgaaaaaaaaattcccaagaatattgtgttcccaaaaggtctgtactatgttcttcaagagtgggttgataaactccaagagcataataggaggatctaggcctctgcccatcagggctcacgtagattaacagcaaaagtccccttttttgtccgtccatcctggtcatatggatctcacagctctgggatcaaatacagaagcctttccaaatgaattaactctaaactactgataatccttggctttgtgtcatgacaacttggcttcctcagcatgatatttgggagcaagcggccgtctctaccaaagtcttgcttcttggagcaccactgagctctttacatgtttaaaatgtagtactacgatgacaaatgctaccacgtgggtacaccctgaaaacattagctgggtgaaagaagcccagtcacaaaatgccatatgttggatggccatttatatgatgtatctagaaccaaaaaatcttttgacgcagaaagtaggtgagtggttgcctgggatctagggaggagaaactccggagtgactgtgagtaggggtgcaggatttcttttccagagtgactgtgaatgacggtgcaggatttctcttccggagtgactgtgaatgcaggtgcaagatttctcttccggagtgactctgaatgggggtgcaggatttctcttccggagtgactgaatgggggtgcaacatttcttttccggagtgactgaatgcgggtgcaggatttctcttccggagtgactgattgggggtgcacgatttctcttccggagtgactgaatgggggtgcaggatttcttttctggagtgactgaatgggggtgcaggatttcttttcaaagtgattgaatgggggtgcaggatttctcttccggagtgactgaatgggggtgcaggatttctcttccagagtgactctgaatggcggtgcaggatttctcttccagagtgactgaatgggggtgcaggatttctcttccagagtgactctgaatggcggtgcaggatttctcttccggagtgactgaatgggggtgcgggatttctcttccggagtgactgtgaatgggggtgcaggatttctcttccagagtgactgtgaatgaaggtgcaggatttattttccggagtgactgaatgggggtgcaggatttctcttctggagtgactgaatgcgggtgcaggatttctctttcagagtgactgaatggaggtgcaggatttcttttctggagtgactgtgaatgggcttgcaggatttcttttctggagtgactgtgaatgggggtgcaggatttctcttccggagtgactgtgaatgggggtgcaggatttctcttccggagtgactgaatggaggtgcaggatttcttttctggaggactgtgaatgggcttgcaggatttctcttccggagtgactgtgaatggcggtgcaggatttctcttccagagtgactgtgaatgagggtgcgggatttattttccggagtgactgaatgggggtgcaggatttctcttccggagtgactgaatgggggtgcaggatttctctttcggagtgactgaatggaggtgcaggatttcttttctggagtgagtgtgaatgggcttgcaggatttcttttccggagtgactgtgaatgggggtgcaggatttctcttccggagtgactgaatgcggtgcaggatttcttttcaaagtgataaaagtttctgaaaagggattatgatggtggctgtaaaactctgcacatatactaaaaagcaccagattgtatacttttagagagtgaatttcatggtatgggaattgtatctcaaagctgttattacaaaaatgtttaaaagaagtgctgattctgacaaactagataagcacacagagctagcgtggggccatggtgcaccatgagggcctgacgagcgcagaaagctcgcatcttacacttatacaggactttacatctggcaaaacactttaacatgtagttacaccttccttccaaccttctgggggtgtgtagggcaggtgacgttatacttattatagggatgacaaaaacaaagccacatagatattgtcagtaaccaaattactcaccgaaagcaatcaatagagttgagattaaaacccaaatcatctgacttcaagactttttccaatacccaagatacaaattatagactctgttcttgaagcttatgattaaatgacctgaatacattccacggcacatcgggtttagttatttttgttgttttaattaatggattgtcatatggcctgtaaggagatcatctatcagtgtggctaaaaatggcaaaacaactgtacgtcactgattacatggcgatatatacatttggtgacagatcctacaaaaaatgtcctactcacacagttaagttacatatctgtattctactcgcgatgattcagccaggttaatcagttttatagtaacaaaaaatgatagagtatcatacaatcaacgtaatccaacagagagcggcagagaggatggggtggcagttcatgtgatttgcctcacatcttggtgccggagggtatggctcagatactaggtctgtctttttgtgtgcatgcattacttaacgaagctcagctgtagttccggtataatgggatgaatgaggctgactttacttctttgtgaaaaggaaataaggaaaagaaagcgctgcctatagtagaatgatttataatcctttggctatgggattgctgggtcaatagcaaagacttggaagcaacccaaatgcccatcagtgatatactagataaagaaaatgtggcacatatacaccatggaacactatgcagccctaaaaaagaatgagttcatgccctttgcagggacatggatgaagctagaaaccatcatcctcagaaaactaatacaggaacagaaaatcaagtaccgcatgttcctcactcataagtgggagctgaacaatgagaacatatgggcacggggaggggaacatcacacactggggcctgtcagggggtcgggggaaaggggagggatagtgttaggacaaatacctaatgcatgtggggattaaaacctagatgatgggttggtagatgcagcaaaccaccatggcaaatgtattcctatgtaacaaacctgcacgttcagcaagtgtatcccagcactgaaagtaaaaaaaaaaaaaaaaaaaaaaaaaaaaaagcactacctgtacgataaactgtgaacaatatttgcttatttaaatccggatgatgaagacacaaaatggagcatggtatgcagtcacaaataacaatggcaggcctggcgcggtggctcgtgcctgtaatcctagcactttgggaggctgaggtgggcagatcacaaggtcaggagatcgagaccatcctggctaacacggtgaaaccccgtatctactaaaatacaaaaaactagtcgggcgtggtggcgggcacctgtagtcccagctactctggaggctgaggcaggaaaatggcatgaacccggaaggcggggcttgcagtgagccgggatctcgccactgcactccagcctgggtgacaaatcgagactcggtctcaaacagacaaacaaaaataaataaaaataaaaaaattaaataaatttaaaaaaaaaaaacaatggcagcagcatgggcagcaacctgacggtaacctatgcacgaattttgatttaaatgaaaaatttgtacctaaagattttctacggcagcagttctgaaacttttgctgtcaggaccgctttatagtctgaaaaatttgtaagaaccccatagtaggattgccacatattctatgaattatacttacactaaaaactaatttgctgttaatatggaatttaacatcctgttgcaattttgtggttgtcttttgtctttgttaaatctggcaacactgcccccaaggagcttttgcttatgtaagttttatctacttatatttaccctgtcaataatgaagacagaggcatttttagaaatttattcataattaaataatagttataaatcattaaattttatgagttgcatatttataagaaataacatatttttaaggaaagtaatttttttcagaagaaaacaatttagccagagaagtggtattgatttacatttgagcaaacatattaatgcctgctttaacagcagacagctggattcttgtaattttttttgcatacaatctgttgtaatgttgtgcactatgtaccttttggaaaaccacattgtccactccgaacagaataagaaagggacaagtgacttctcaatattgtcctgataagagttttgacctcatggcttctgagagtacctcagggatcccccaaagggtccctggaacatactttgagaatcactgtttggtggcttctgatttgttactcatgagagagagttctttatcctctgatcaacttttcagatcatcattttttaaaaaaacaccgtctcacatatatcatcacaaagaaaatgattttacaaacgtcaccttttgttaataaatctcacaaagacctaacaaaaatacagtatgttccctggggtattttagatgactccttgaactcaagctaatcccgtctcaaacatggaaagcttaagacatttttagtactataccttttcttaggacacttcttaaaagacagaagttttcatggtgtgtgtgtgtgtatgagagagagagagagagagagagaaagtgagctcttatgtgaaaattcagcagcattctcatcttacttaaacatttttttgacctacaaaaagctgtacataattaatatatacattggagagtttgtggggtgtacaccatgaaaccattgctgcaatctatgccataaacctatacatcaacactaaaatttccttttgctttatgtttattgttattttgtgatacaaataattaacataagatctacccttttagcaaatgtaagtacacagcaaagtattgttaactctaggcgccatgctacacagctgacctctaagtcttacatgattctcattttatggagtattttcatatctgtggtagatatggtaaaagtccacatgtgttttgcatattccacttaccttctggcatgattgagagtcttggaatgtctttctgtgacttcctggatcccaccttctttattcctataaaataacttttgttgttgctgttcatggatggctctctagagaggtagggattaattggacttgtggggctactcctgtctagatattgtcttatcactgaagatggaacagaaagttggaaacagcagccatgaaccaaggaatacaggtcaaaaacaaggacattgagaagtatttagaaatagtccttaaaaggatgaaagtcagaaccagaacacaaaatgcaaacccatctgaagcatatgctgctgaatgtggtgggaaaggctctaggctttgatgcatgttttccaaagcactgacatgatcccacacccagggctctgagtgagagccatggattctatagagactgaatacaatccagagtgccctgggccagtcagcacaccctcaggaagcaggcacgccctgtaggttgccttatcttcccctgttaagtctgatttcatagaactaagacgtcattccatttaaagacacaggctgaaaacttaatctttctaacttctgcattagactttccaggattcatcagtaaaaagaatgaatagctacgattgtagtgtgtctaaagtcatgtatatgatgcatttcattatcagtgtacctattaatagaaagaaatgtactgtataaagttccactctctgctatgtactttcagtattcaaattttatctatagttctgggatctatggctgcaatatggggccctaccaacttcttaagcacaagatgcatctttgtacaaaagaacacttatctctacaaacacctgctggtacggataacctgcgttttggaaaagtgatactcattctttatatcttgacactgacaactcaccaactttgcaaacaggatctgccagaaggataggtaaaggcaattgcatggcctaaaataagttcagaaaaaaggtataaaatgaccgtataaaaacaaattttactttctggtgagattttattgttttttgggtaaagggcagaggaagacttatataacaatataccagctacacagctcattcctgatcatataaatgctacaaaaaagactcctaatgctaatgtttgatgtaattacagcaacccaactggccaaaacaactaaatctgatttgggaagcatctaggaagaattatatgtgcacttatgtcattgggtaacttaactttcttgaaaaatatcttaagtaaaagcaagttagaatcctccgaagcttctgaaaaaaattatgtcttggatccagacacacaaagaaagggaaagaaaaatatgaaatattatacagctcaatagctctataaagactttgtaagtaagaggatgtggatagatggtatctacagttgggttagaagccattccctgaaaaccaggattgtctaaccttgacgaagtcatgtttgatcattcacaatagtcttctggaatcatggctaaatatcctatgtcttcttggggggagaaaaaaaacatttgtcgattaaatttattctccagggttagagtatcttgaaagaaaattcaggttgtggagaatcatagtccctgctaacgtaacctgttatttatcaaatatgaaagcaaatttaagcaatgataattataataaccctacgtttctggttttctaatacttctaggatattttgcaaaaattacacaatttttgttaattcccaagagtgatgtcaagttggtgaaagagacatgatcagtgtttaccaatgtgtgtgtcagctaccttcgtaatagaccacaacacagttctataattcagttggtttccactgtctttttcatgagtgtgtattcttgcttgcacaataattacctgatgtaaaaaatcatctagcaattattttatagttttttagtactaggcatttgcccttgggcatacataagtaagatgcaattcttgttgaaggaggagaccacgatcttcatggtcagcgtgaacctaataccatagtattttgcaaaagtatttctgacattaatacatttcctattatgtagagcttggtaattgcaaaggatgtttgctttataatgggaatctcttgtctagtattataatcaaatgtagcgcatgaaataatactgtgaactacaaagtttctactcaaaaatcacaaatgttggttctctcttaacaacactttctccctttttatgttcttatttttagtttgtctcattttccaaatctctatttaaaaaatgtgtcccagggaaaatgaatagcctagagtaaagataattcatcacccgctccactccttctagagctgaaacagagctccccactgttttctggaagcaacgggcaaaggcagcgttcaggacccagatctatcatggatattctgcccctggtctcaggtggttactaaggcctgcacttatcattcaataaatgcatgtgggactggaagaatcacgatggaactgtggacacatgtcaagagggcctcctgggaagcctgctgcttctagatagtaattgacatgtccctgtgtggaatgctggctattgattgtccttgtgaaataagcattgcccatgtgatgacgaggtgacacctgaccatccctagcttgggagacttctattattttttaggttggtgcaaaagtaattgtggttgtggcatttaaaagtaatgacaaaaaccgctattacttttgcaccaaattcatacttcatgtataaaccagataattacaatttcttatgtgcaatcatttcctttaggggttgctacaaggaagagtaaatactgttttactagaggaatggcgctaaattgctcttacgacaaatcaatgtgttatctgcataatttgtaatatgttacagctcatggttaaagtagagcattcccattgttgggaatgacagttggtggttcagctgtgagtggaaggggagtgttaagattggaggtttctcactcactgtctgctgagaaatccccatgccgggagccttggccacatagctacctacagaccatactacagagtgttgtctttcctttcctctctgttcgagtgaatgatgcttttctctaaaggaccacttcttccttttttgttggtaggtgggggttgtggcatagagggaaggtgggagcctggtcaacttttcccaaataataatgttggagtagattgaaaatttagcactatgatctggatcatctttcagaaaggttgatgtatttgacttgcagtttaattgacatcgttaacagaaaatattgaatgtcttgattcaaaatataaactgcaattattttgcacaaacctagtaaaaaaaatacgtggcaagttgttctgtgatgccatcagttttctgatagtgtggctttgaatgtggcaatgctgttaaagttttactttttaagaatacttagaagtcatggtaaaattaaaagaatgaattccaatttttattatataaattgttgaaaataaaaaaatgcacaattttgactcaccgtaatttactggataatttctaaatactttgtcgatagaatcatgtatgataatttgtttgaaagaattttaggatcaaatatcagatttggttttaaaaactctgggcgtatttattgtctaaggagataaagacatttatttcatcaacatgactcactatatgtaataaatacttcactaggtggcactgaaaaacccaaaccaaaccaaaaaaaaaaaaaaaaaagaccaagtgtgatgaaaaatggtcatgaaaatgcagggttcataccctgctgtcatgttttcccatcacatatcccgtgggcttcaccaacgtggcctcactcagctgtcctgtttcagccacaagcatcacctactatctgtgcagaaatcaactcttgaatactagtgtatattttctgctattgtttgaaaacagaggaatacatcttctttctattgcgtttttcttgcttttaacagtagaatagtacctttttactagcaggttgttaacacatatttgtccactagatgggtatttcattttttttttttgagtgttgtcttcattctttatacacttcaatgtttaatatataaatatattttaatttccccctagcttcccccactgctttctttatacatacaaatatgatgcataggtctggatttcctttttaattcaatgcctggggagttttttcttgggactattccagagtctagttgttcgttcattctaaaaaacacagggaggatttaccacatcagaaactacatttaatgttggagatccaaaacctaacatagggacccatttgaggagagcgtaggaactgctggctggggaaacacctggactttcacagagcattgaggagcagagctgattagaaatagcatcatgattggctttgtaaagaccaaagaaggagaaaggagttggaggtcaagatggcacagttaagaaacagtatggttgacatggtttaatggtaatgtggtatttgtatacattgctctgcatacaattatgttattttaatatgcattattttatttatttcctacaagaactccatgaggtgtgaacaggaggtgtcagcagatcatttcataagcagacctttagtagacctggattagagttgccttcaggccccggactggaaccttggttttctgacttgcattatttcttctaccacactaatattctgttatttgaggcaaccacaattgcatattctgtctgcatgtgtgtgagtgtgtgtgtgtgagagagaaggaaaactagcaacagccatcctacactcctcttatcataacatatgtgtttcaatatttactttattatgagttttacaccttctgaaccagtgtacttaatacaaaagtaggaaaattcatctggaatgaaaaaaacaacagctacaacaaaaagtcactttgatgaagcagcagcccaggctgagtctattatgtatacagtttcagaactgcaaaagagataacgtaaaaaccaggtatggcaaatgatttgagggtcaatctatgtttgtttttatatcccttgctcccacagaagactgtgaacatgtcaagtattaaggacctattttgaattactaaatagacgagatcattaccattagcaaaaattagcaccaaaggatgtataatgagaattattttggcccactaccacccaccaaaaggttggagtttctatatctgtgaattttgcagctctgcagagcttatgaaaacctgctcattttgtcattaacacaagccctactccttagtacttgggggactttgaacatgttcttaacttttccatttccaggttcttccctagtagagcaaggataacagcaatgtccttatttgtaggatccttaggattatggaagtaagctcctggagaacacgtagccagggcatggttccctgaaaaggatctattagtgtgtgctattcttactgttcttatttctgcagtccttgccacatcactgctaccaggactccttcatgaaggatggagtccaactcccaggcacgtgtggatagggtaggggttggcctgctttggtaaagtgagatgataacagatcacacagcaagacgggctgcggacagagaagaaaatccgaacctatagtcagaaagggtctggttccacttgctaaattctgtctcttatcaaaagacaggttttgaaaattattgcaacagaattatcagttatgtgagctttgagagttcttcatttaaaaagatacctcagatattcttaattaatccattttgtgtcttgccattttgttctgtaatttccttgctcatctgattgtgggtgagatttgtaatgaactttctgatacataactatattataccgttttaacgctgctgataaaggcataccggagacttggcaattaacaaaagcaagaggcttgattagactcacagttccacatggctggggaggcctcacaattatggcagaaggcaaggaggagcaagtcacgtcttatgtggatggcagcaggcaaagagagagaatttgtgcagagaacctcccatttttataaatcatcagctctcacgagactcattcactatcacgagaacagcccaggaaagacttgcctccatagttcaatcacctccccccaggctcctcccacaacacatgggaatcatgggagctacaattctagatgagatttgggtggggacacagccaaaccgtatcaatgactccagaggtttttcacagttcacttgattttcaaaatttaataaaaactaggatacaaaaaggcaggctatctgggaactttcataatgatcccttaaaatgtacacatcttctcatggtgtgcctgccatggcgtgcaatttgacctgacagttttcccaggagctaaagcgctgagttttctcctacatggagcttgagtaaccatacagtaggccacccaggtgcttggttttcctttcacacttaagtatccagtgaagagctttctctaatctatgccttctgttcttatgagctatgtctattgaaatgtttggcttataccagaggagggcaataaaataggcaacttttcttcgcaataggacctgagggccacctttttctaccataaagttaccttgcaattctgttatttttgtctctttatttttgtatccatcaatgaaataaaaagcattactctatcatatcatgtatcactgctatagtagacaagaaggaaacattcattcattaaatcttcgaagtagaattttcttatataaatgcatattcttcaagaacaacataaaatgcagcaggtatatgattctttaaaaatacaaataatacaggctattatcgatgttttgttttgttttttctttttctattttagccctgcttaaaggttcttaaggcttcccagctcatcttcccatttcctatctttactcatttatctggaaggaaaattcattcttccttcacagctatgtcttgaccccatgacactatgactatcattctggttcttttttgttacattttagtatttttatatagaaaacaatttttaatgtatatatttatttagttctttttgtaagtcactgttcattttgaaaattgatgaactttgaagaaacagttgtagggaaaattgcaaaatcattttagaagaggaactctttaatatctttcataaattttctgactgtaagtaattttatatgcgatggttgaaacagcagtgggcaacagcaatataatgagccatgaatgtaattccaaatgagcagcagatttaaaaattcataactgatatgactaattttaataatgttaacccatgtgtccaaaatatttcaacatgtcatcagcaataagttataatagagtctattaaaagaagtcttagaaacctggtatatacgttatacttacagggcactccaatataatttcaaattttcattgcaataatctatatttaaaattcataaattaaatttaattcaattagagttaaataattggaacaaaagttcaggattctgactttcacatacaaacaagactttcagaacaagtctgttcatggcgtatcattgctagtagggggaaataacttatctaaaccaagaactcctgagtttggctctgcgttcgcccccaggacataaccactctgattatctgtttaaaaatggggaggttttctggcttctaagacacctatcgggatgtctttctctgctttagtactgtgtgacccatttcatcttcccatgtcttattaagatccaaatttcctatccactacaaatggagatctatgaaagacatgattttgctaccagctagccaacattatatgaagaaaagtcgtcttctctaggctgtgaagtgtaataccaaattcattgactattatctacagcaaatgttctacattagtcatgtgaaactgaagtttggggagtattattttgcaactatgtccatgtgaaatcccaaaagcccaggtaaaataagaaataggacaagaatctttctgccacgatattgcatttttatgagtttggaaacagagccaagcttactgattttagctctaccactttgctctttcagatgaatgtataaataaaaaccagaacatcatgactaaatgcaatactgtaaaattatctaaagagaaagttgagtgttaaacaagcatagaatttattctaatttatttctaaatatcccttcataatttctctgataacctttggttgaatgaaaaatgtatacacaccacacacacacacacacacacgcacacacacacacactacataatgtaagagaatacattactgtttggaattcacttcctcatgaaccaaatctagtgaatttcgtcatcctataagatctagctcagccatatcctctttcatagagctatccctggctccaaaaggcaagaattttttttttttttttttttttttttttttttttttttttgagatgaagtctgactctgctgcctaggctggagtgcagtagtacaatcgcagctcactgtaacctctgcctcctgggttcaagtgatcctcctgcctcagcttctggaggagtagctgggattataggtacctgcaaccatgtcgggctaattttggtgtttttagtagagacggggtttcaccatgttgtccaggctagtcttgaactcctgacctcagatgatccaccctgcttggcctcccaaagtgctggggttacaggcgtgagccaccatgcccagcttcccctagcaaatttgattaactactttaaaaatttttatacatatattaattttgaatatgtatttatttttatgtttactttttcattttgattcttttcttttttatcatttttatcattgaaccataagttcattcatccatgcatttaggtactcttccatttaaaagatattttatagattccatataatttgccaggccagcattgagtatgcattgagaaggcaacaaactcattcctgttcttcaaagatctagtaatttattagggaatcctgactgcaagaggtaaataatttaacacattaatgcaaaatgtaaaatactattagcgtcgcaaacagtatgttgtgataaggaatgagattaaattggtgggaatggactcttgttctaaaagatgtgaaaaaactagccataaggagtgtttgggtaaaaagaaattatactgtagtgcagcaaaagagaaagtggggagtctctttgcaattaaaaaagggagaatgtgtctattaggctgataaattctttaactcatgacacgattttatggggaatgtttacttgaaaacctttgaagagtattggctctgtatttagaccatgccgaataatctcctataatttacttagattttattttaattattctatttttcctctttttttaaattttattttattattattataatttaagttttagggtacatgcgcacaacgtgcaggttagttacatatgtatacatgtgccacgttggtgtgctgcaccgttaactcgtcatttagcattaggtatatctcctaatgcgattcctccccccgccccccaccccacagcagtccccggtgtgtgatgttccccttcctgtgtccatgtgttctcactgttcaattcccacctatgagtgagagcacgcggtgtttggttttttgtccttgcgatagttttctgagaatattaaaatattactggtatgttttcatctcagtaaaggatatcacgtttatgtcttatatgtttccctcacacagtcaaaaaattagtgttcaatatagttttttattatgaagtcctcatatttttaaggaatcacaaattgtcttatgagaagaatcttttatcctgaagatggaagctttgcgcttttacctcactctgctgctgctgctgggcgtcggatgctgctgttttgtgtctgtgggagggagaaatgaaaaggccagatttatgacaacatgaggcattgagtcagcccacatgaatatcattcgtgccatactctgtcttcttgtcttatggcaagttatatttccagtaaaaacataatactgtaattcagaatgttccccctagatttttggatgatattagacatttgaaaatcttaataaacctttccgtgagctgtgcagtatttatctttcttaaacagcttatgtatcaatttaatgagtatcaatattgaatagaacaggtttagaattttatcatagctacctgaaattcattaaaacatggaaatgtcatatgtactcttagactgttactagacaccctactcaaatgcaaatcttatcaactacaaaatacgtgtggcttttgcatctgacaactgttgaatatatgtttgacaatcatgtttaaagtagattttttattatttacatttaagtttggctttggtagccattacttgaagcattgagatgaactttttgataaacgagttatttaaaactaagtattagtattttgagtgtttgattattaacatatattcatacccatttattcagtttgaataacttcgtggctcttaggtgtttaaaggctcgtgcatgttaaatacattatacatatttggtattaactctgtaaaatgaaactgctgtagaataaagcagtaaagggagttagaaatcagtagttattaagcatttagtatgccacagttattgttccaggaacattatctatgtgtctaactgaatgatcacatctctgtgaaatacagactcttctttattatctgcgtgttataggcgaggaagccagtggtctgggagattagctgtttaacctatgactgcactgacagcaaattagcaactggtgcaatcacattcacagcggggcctgcctgaccctcacgacatacagcttttatcactacgttagtctaaaattactctctgaatgattatttcattgtttatgtataggccttgattgtaatatgatatcattatgtctcataaactgcttgttttcttatatgaattagttcatacagtaggtacttataatcatgttttcctttatttcatttaagcagtcttctacaggaaaagctgaaaacataatttaaatttctgcattcacagtaaaacacagaaaaacagagatctaaataattagtcttccaaatcttaaactatatctgatatagtccgttaacactgctcttagcgttttcatctttcatagtgaaaagtaatagcacatgaaattaataattctgagtcatgagattcatattcttataaaaatattatattatatttgtattcaccctagagctagtataaagaaaaaaaattggctatatcatgctgaaaataaccaaaataaatatttaataaatacctcctgggttggtcaacaagaactttacatgagttgatccaaatgcaaagggaccttgttgttagtaagacattgatttgcaaagaccccaggcagtgtgtaggggttggaggaatctggggctgatcatggaaaagataagaacttgagagaggcaggatcacacaacaggttttatcaggcgatgcttgcatgagaagggagaccccatacaacacaagctcttccagaggcttacggcagtggctgggggccacaccaagcaggggagaatggcacatcaactccccaaggaagggggatcatagaagggcccggggtccagccgttgtctctcagcagcctggagggtgaggcgtctctggggcagaggccttccatggacaccagcagcttggagtctgtgttagtctcaggctgccatgataaagtaccacaaactggatgccttaaagaacagaaatctgtttcttcttaattttggaatcgagaagtccaagatcacggtgtcagtggggttggtttctcctgaggcccctccttggcttgcagaaggccccttctctctgggtcctcacgtggtcttccctctgtgtgtgtctgggttcttatcttctcttattaggaggcaccagtcatattggattagggcccctgcatgacctcttttaatcttaattactctctaaagaactcagcccccggtacagtcacattctgaggcacctggggttgagatttcaacatagcagttttgggaagacagaactcagtcctcaacaggatcttacaactccaaagtcttatcttatcaatgggtaacagctgtcaggtgaagttttgcagggtatgcaaagcaggcaggctctaaatggctacaagtctgctagtttgggctatttttaaaataattggatgtgtaaaatttgagtttggtgccagcaggcttatgagctaaagctctcagcctgcaatgaagaaataaacaacccgggcatcagtgcacacaggccgtctttggctcatttataaaacagagagttgcagagcacgtccagactaccctgggctctacagggctcataagcattcaccccagcactgcaggacagcctcatcttgcttaccacaggcaaacaccctagagggaatccgttctcatttttattttgtttctgttgttgctattgataaaatttagatgtctcatgtaaggcaagtatatccagacttgaatttaactgggtttatccttactcaattttgaataactgtatgaagtttttaataaaaccgtgtatttctttaagctcatatttctagacgttcttttaaatccagatcagatattaactctcctctgaaagcgttcctgactttgtcaagcagacaaagacgcctcttcatgggtcccataacatttaacatctctctccactatgtcatggcacctatcaagcgaggccataactattgtttatttacatgtgctatttctctgagtacatgagccacatcagatcagagactgtggtctctgcatataattccatttcctagcagagcacctaacgcgtaatagagactcattaaatattttttaactacttaatgaagagaagttagaagcagttcctaaactcagacataataacagccacaccacaccgaccagtaaattcctttccaagggagctgctgtaaatcgtacaaagaatggattataaagtatcatttgccttctgggtgtggagtgtagttctgaaagtgcttcttcttttgagaatggaaagctgccatggaaataaaatgtaaatcatttccactgaggcttaaaaggccaaaaatcttgggtgagatatgtaatgaatgagtctggattcatattgcttactctgttctcgagccatctttgtttttggtgtggttgtttattttggggaggaggtagactttctctacctgtacaagttggaaaacagtaacagcagccagcactaaggtatgagtcatgtaatcaccagagtgtgtatcttctttattctccactgttcacaatcatatttggaggaagttactaatagcaggtttaatttgtatctatattaggtaccaggtactctatttatgtagttgaggtctacttttttatttaacagggctgatgttgcttttataaaaactttaaaaaccaagatacaggaatgtagattaggtcaagcggtctcagtagctaagttttgagttggaattagcgtcagttgttttgagttctttaactcacgatgttccctcttcgttgattcccatgtgtgcgtcacctggagaatcatcaggatgctacttaaaaatgcatatcaggcttttcctgtggcattcagatctgccttctagaatggtattgtggactgcctgtgtccccctaaaattcaggtattttacttctgatctgcagtatagccgtatatggagagagggtctctaaagaagtaattaaggttaaatgagataataagagtggggcctgatccaaggggatttatatccgtataaaaagaagcacagacaccagaggaaacctccccatcccctactctgccttatgaggacacggtaagaaggtggcattttgcaagccaggaagagagctctcaccaggagctcactctgtgtgaatcttgatctagaacttcagcctctagaactgtaaaaaataataataataataaaataaaaattttgttgtttaagctacctagtttgtggtatttcattatggcagtctgagctgactaacacaaatgaggaggctctttagctacaatctagggttaaaaagagtcccaagtgattctttggatcactcaggtttgagaaatttgacatcacacttcaaattagcaatacctaggaaccactgatcacaaaaatcagacctagagaggaaaataattttatggttgtcagagcagtacatcacagagaaagcgtagcttaagtaatattccccagctgtacataaggaataattattttcatcgaaatttatgtatttttgccaaagtagcaagtttatgtgtgtgtatctgtggactttaaagtcccccagaaaatgaaattacctttctcaattatgagtacaagtgcaaagaactcttcctttaacttcattgtttcatcttcaaaatttatcttttacatgctccatttaacacaaatgtgcttaatcagtgtgtcacttgatatgattctctagaagatttcatgaaacgagagttcttctctaacttaaagagtaaatgttacagtccgacatttcatctttgttgtgggtatgaaagaattgggatctacttttaacatgctttgaacatgatcattagtagaattaaaattttacaggtgctacttgaggatttctctttaaattagcatcgctatagtagcttcgatgtttgctgctttatgttttactagatttagttttgtagagtagttttaggtgcacagccaaattaaggggaaggttaaaaaaaatttatataccccctgtccccacacatacaggatctcctttattatcaacatccccccataagaatggtacatttattacaatcaatgaacctactttgacatatttcgattaaccaaagcccatagtttacattggagcgcactcttgctgttgtcaattttatgggtttggacaaaagttcaataacatgtatccatccttatagtatcatacagataattttcattgtttaattatctgtgctctgcttattaatccttctctccctcaactcctggcaatcactgacctgttcactgtttccctaattttgctgtttcgaaaatattacacagttggaatcatatactctgtagctttttcaaattaacttctttcacttggtaataggtatttaaagttcgaaagagctgacaacttgacagtactgaggtttttttttttttaaatccatgaacatgggctatctctttgtttagttatttttttaattcagagttttatagagttcttcatatacattttgtatgtattttgctagatttatatctaagtatttcattttggggtatgctaatgtaaatggtattattatatttaattttgaattccatttcattgccggtatataaaaaagcaatttattttgtgcattagtgttaactttgtatcctacaaccctgctataattgcttattagttctaggaaggtgattttttttctcaattatttaggatgttatacatagacagttgtgtcacctgcagggaataaacaacttttatttcttccttctctatctgtattccatttattttctctacttgctttattgcattagctacgatgttggaaatcagtggtgaaaggggacatttgtgccttgtttcctgctcttagtgagaaagctttgagttttcattaagtaaaatgttagctgcagggttttttggtagatattctttaccagattgagaaggtttccctcttgttctggtttactgaggatattttttgaatcataaatatgtattggattttgttaattgcttttctctgcatgtgttgatgtgatcatgtgattttttctttaacctgttgatgtgatatgttaattaatttttcagtattgaaccagccttgcatacctgagatgaatcccagtgaaacatggtatataattctttttatacgttgttgaatttattttgctaatattttgttgaggatttttgcaaccatgtccatgagaaacgatggtctgcagttttctttttttggaatgcctctgtctggtgttgatgttagggtaatgtgggcctatcttgttaggaagaatgaaatgctctgcaaaaatggttccttttcccctccccaagctggaagcaggaggaggctcttctccaatattccttgtgagaacctagtgaagctccaggaagtaaaactcataatgtgtagacccctgatgattgagtcctcttggagtaaaactaatgtcatgaatgggccccctaatgactgagttctcttggggaacactgagccagcagcagttcatcagttacggctctgccttccctactcccactctggagctttgtgcttgtgggtttctgccctggtaccatcactttctgtagttccctgtatgtgtctccaatcttgggagcagcaaattgtcctatgacccccacctctctgaatgatctaagaagaattgatctttcagtttgtggagctttctcttaggacagagtggtgacttccagcttcttacatgctgaacaggaaaccagaagaaactgtattctgctttttaaaacaataatctgtataaaccagaaaatagaaaccagcaagtttgcaaagaatcctgatttgtattctcctgcgaaggagaagcctgcatgcccctcctctggtcactttcctgtgctgtctatgagggcagttgatgaggtgaggctgagtgctcccagccctgggactatttctggaaatcggccgccaagtctgagaattcacactttcttttgggacaggttaaaaatggatctgtacatggactgatgactattgcaggcttgctatgtgggaaacaaaattaacaaactcttgggaacttgttcaattttatgttggtattctgttcacatctggaattgaacaggagagtgctgaccaggctgaaggatggctgagaaagaaagctcaagagaggggagaaaaataaaaggcagccacataggttaaaggcactttgaatcattccttagagattgtcaagtatattctcttaactaataaaatggaaggaaaggaacgggaacggagaaggagagggacagggagagggaggaagagaggaaggaagggagggagggaaggaaggaagggaagggaagggaggagggaggagggagggaggaagagaggaagggagggagtgaaggaagggaagggaaaggggaaggaagagaaaggggaaggaagagaggagggaaggagggaagagggaaggaagagaggaggcaaggaagggaagggaaaggggaaggaagggaaaggggaaggaagagaggagggaaggaaaggaagacggaaggaagagaggagggaaggaaggggagagggaaggaagggaggagggaaggaaggcaagaaggaaggaagcgaggagggaagggaagagggaagggaagagggaagggaagattgctttgagtagggaagagactcacctaagttcatgaagctaattattatctgaggtagaagaggaagtctcttcccttgtcccttagttaataaagcgtatgtttggaacaaagtatttgcttttttttttttttttttttttttttttttttaggcattatgctttttaattgtctacaaaaaatataagaatacctgtatggctaacctgggaaatatttagttgtagtgtgtaacagtctgttctcatgctgctgataaagacatacccaagacttggtcatttataaaggaaagaggtttaattgactcacagttccacatggctggagagacctcactatcatggcggaaggtgaatgaggagcaaagtcacgtcttccatggcagcaggcaaagggagcgtgtgaaggagaactcccctttatacaaccatcagatctctttagacttattcactatcaagttaataggatgagaaagacctacccccaagattgagttacctcccaccgggtccctcccacaacatgtgggaattatgggagttacatttcaccatgagatttgggtggagacacagcaaaatcataaaatagtgatttaaggctttcatatacctctatcaggtaaaccacataaacaccctgtcagggcgacaggagctggcttcttgtcctactaagcaccagctgtgaatcttggggcaatttaacatcccaatgcttcagtttccatatctgtcatgggggtggtaatgataatatgatatttagtgtgtgtgacaactaagtaaatcatcacatgtaaagaacttagaatgaggcttaataagtgtcaaaagtgtctattatcagcatgactgtgattattattatggacttagcactgttcctcctcacaaagaacttgatgataatggtctgcagggtgacttggctggggtgtgtctgctttcgctctgcaggactggctttcctgaccagcatcctttccatttccatgtgatttcctctctattacaggaggtagcagacgtagacagcgtctagtaagaatcccatggcttaggtttactgctcttgctggaacacagtatttaattctttaattaattctttacatttcaatacatctgattcccctttgaagcagctaaaaatggttccagaccaaataccagctgccttgttatcaagctttatttttccagagggtgggggttggtagggaggaaacatcttccaatctcctgactcatttacttataaaagaaaatatggcatattctgattctctttgatctctttaatatgcagtaaacttcatcttgcaaatttataatgtttggatgattttgttaaaaagaaagaattaatacttcaattctccctaaaaggtctattgtttattttacttcatttatcattccaagtattttcttttttccctctgccttattcttcactctcctcttctatcatctttgcactcacacttctggaattcctgcttctcatgttgtcttttctcaccctggtaacacagacttcacatccatgtcacagccgcaggaaagctcaggctgccctcacattggacctgtcctgtgggatttatgcccctgtgcaccatcctatttaggcattttcctctaggaagaaatgctactaaaagcttccagaaagcttacattccaaaaaaaaaccactaaaatttaatatttttaaatagtagacatattatgactggctgttttgacattccactgaaataatttatgagtgttttacatctttacatttcagtacatctgattcccctttgaagcagctaaaaatggttccagacccactaccagctgccttgttatcaagcattattttttcagagggtgggggttggtaaggaggaaacatcttccaatctcctgactcatttatttataaaagaaaatatggcatattctgattctctttgatctctttaatatgcagtaaacttcatcttgcaaatttataacgtttggatgattttattaaaaagaaagaaaatactactaaattaaattctggaataaaattcttacttgtttcattggtatctaagtgggttgactttgaagcatggcaaagattatgtataaaattcaatatcaaaattaacactgatatttgaactaactggaagtcccatcttatacaatcctgtagttttctcgaaggaaaaacatatcatctttatctttatatcactccaatgcatctagcaaagtgagacacacagctgatgaaaaataaatgtttgttaaatgaactgagtatgggcggtatcagggagatgcttaaaatgacacctcctcagaattgaaaaaaaaaaaaatattacctcttcccctgcctcctacatctgcaatttcactgtttttgttttttggggttttttttttttttggtattttttttctacatagctcacaatctccagatgctcatttaatagggacaattttaatttctctcttgtgactgagaaacgttcagttttgtctgtgttcgtaggattctcacacttgtctctactatgagggtcccctcctgctgatactattttcactgcctattcacataattccaaatatctttcactttcatttcaaagatgttaaactgaaattgaccagtgtataatttttccttcagctccaaagaaaccttttggtcatacaagcagacattctcatataaagcttctgtttcattacaactcttatagacaatcatcaagatgtctttagataaactgatctacctcttagcttgaaaatgtcattttctcttcagcctggtgagtatttatgtatcttccattgccttgctcagatatctcccacttaatcaaactttcttttttgtcacaattggaaatagatgtttccaccaatggcccattatataagccactatgataacatgcatgtccatgcataagaattgaatacttctatgtcattttctcccctaaaaatcataagcctctagagggttagactcttgtattttacttatttgtaatcaatagccagagataaggacagcctggcacccataaaacactggataatgtgagcagaacaaatatttggagtctatgttatatatagcaccaactatctaatgggagagtcttgtaaacagattagggtggcgttaattgaacaattattcttttacaaggtaagtgctgagctagaatttaatgaaaatagtttttagagaaaataagtaatatactgagctaacttttgcatgggtatctactatctaggttttttattgtgtcttattaacaaacagatggcaatactttttttcagtaaactttcagaaatatggaagaatgtaaaagtttaatcttatgaaatgtatcaaagtgtaggataataaacaggaatcaaggtaatcaataagcattactaaatatgtgtttatttccttttgaaaaggcaaggaattttgaaaatgtcctggaaaagcattcttaggaattccttcaccgattcaattttgtttatgaaaaaaatgtattcgatcacctttctccttatattttaaagacagaaaaatgtacctaagatacagaaattaaatgctccctaattatttatgttataaacttatcaatcgtacaaatataagacatggatttctatcctaatttaaaagatgtgtagttattctgtaaattagaggtggctctttcaggaaaattaaagcatttatgcttatttaaccatatataagctgatgaaacaatacactctgaaggaaagagaagctgactccttattcagaggaggttaagctctgtgaaaaacacactgaaattatagggtcttatgtaaaacaaggttgtttgttgctcatgtgaaagtcttgggtagtgtttagaatggtagtgacttcctctccgtgtaatatttagagacccaggtcccttccactgggtcctcccatccccaaccccgcctcctgccatccgccattgtttctgaatgaagaggggctgcagatcccttagcataggggaggggagtgggaagtttgctgggctaggcctgaagtgcggcgttcatcactttctctctctcccctttgcactagacttgggctcatggaaaaggagtctgggtgctacggtctaacccaccgtgggtttcagtgggtagctggtactcttcctttttcatcaccgaagcttccatgaatccgtctgttcctggaacacattagtgaggtgctccaatagctgtaatttctattaggttggtgtaaaagtaattgtcattttttccattattttcaatagcaaaaaccgcaattacttttgcaccaatctaatacagcagtaactgggctgttggcaactcctagaaagactattgtggtaattaattttggttattcgaatggcttttgattgctttacatgttagatgttcaaaaatatgtttggggcagagtttgagaccagcctgggcaacatattgacaccccatctccactaaaatacaaaaattacccaggcgtggtgacatgcacctgtaatcccagctactcaggaggctgaggcatgagaattgcttgaacccaggaggcagaggttagggagatgagatcgcgccactgtactctattgtgggtgacagagtgagactctatctaaaaaaaaaaaaatattgaacatgagtgtggaactcatatgttggtaagaacaaaacttacaagccactgagttgtagcttagggttctgtccaaaggcttcattggcagatgaagaaatgaaagctcttagaactccctcagcaaaactggagcaacatggacactggactgcaagttttggtcatgttagaaagaaagaaacttctctctgaaaagcacaaggctaagttattaagtaagaaatccattccaatagcattattttgatagtatatgaatatcaagattctgaggaatcagaaaaattaaattaaatgattaagcagtttataatagcatattagttctgaaataaaataccaattattactgtttaaatcgagatattttgtttcaaagttttattgatttaatatctttatttatcatcttagaaatttatttacagaattaggttcagtgatctctgagtaaaattgtttacttattttcagttttctgtttctcttttacctcgttggtgattttcctctgttctaaagaacacatttatcattattattttttcataaagtaaggaaaaactttctctacaaatcaagacctctaactggattatttaaatctagaggaaacaatgcaagctaaagccaccaggtttttatcattgtggggtttggttttgtttttctgtttttggatttgtgcttatattggtgttggtaggagtgtaaattagttcaaccattgtggaagacagtgtggcagttcctcaaggatctagaacagaaataccatttgacacagcaatcccattactgggtatatacccaaaggattataaatcattctcctgtaaagacacatgcacacgtatgtttactgcagcactgtttacaataacaaagacttggaaccaacccaaatgcccatcaatgacagactggatagagaaaatatggcacatatatatcatggaatactatgcagccataaaaaataatgagttcatgtcctttgcagggacatggatgaagctggaaaccatcattctcagcaaactaacacaggaacagaaaaccaaacatcacatgttctgactcataagtgggagttgaacaatgagaacacatggatacagggaggggaacatcacacactggggtttgtcgggaggtgggggccaaggggagggagagcgttaggacaaatgcctaatgcatgcgaggcttaaaacctagatgatgggttgataggtgcagcaaaccatcatggcacatgtatatttatgtaacgaacctgcatgttctgcacatgtattccagaacttaaataaagaacacttcacatgagatctactttcttaacaaacttgtaagtgtacaacccactattgtcagctgtaggcacaatgttgttcatcggatctccagaacatactcatcagatataacccaaaccatgtaccccttaaatagcaattctccattttcctttcttccctacacctggcaacctccattcttttctctgcttctgtgcattgtagattccccatggaaatggaatcctacggtatttgactttctgtaactgacttggttcacacagtataatgaccttgaggttcatccatattgttgctatggcaggatctcccttttgaagagtgaagagtaatcctccatgggctatatatacaccacattttctttatccatcaatcagtggacatagtaggattttttctgtacctccactgttttgaattacacagcaatgaacatgagaacacagataacctctttgacatcctgatttcctttttttttctttttttttttttttgaatatgcaagtagtgttgctggattatgtgatgattccattacagacctcggtttaattttgaagcagaatcaggtaggagaggaaaatctcttgtttaccagtgattccatcaagaatattctctgagaaaaatgccttttaaaagccgcacataggtgatgacaataattcacattgtcacagtgcctgatagttcccgagacataggacagaccagcttcccgaatctccccatttctgtcccctaatttccagctcccacttgttcattagacgagtccaggttaatgcatcaggccaagttagcaaaaaatcatgtgttgggcctcggttgcagtgatgatcattactcaagctggctgggtcaatgcagttatttttatttttatatgtttatcatataccaatccatttgacaaaatcatttattggatttaacggtgtctcaggtgtgagtgcttggattttctaagaatataataatatgtataggtaagtatctttttctaaatttatttggaaacatattgcgaatataaatgtattttctcgacttattttattagctgatacattcaaaacagttgagcaaaagttgagtatgatggtaggcataaaaaatgttaaatggtagtcactcaatagttattgaatgaatgacagcaaatacttcaacaccttcttatcataaatgtcaagcaggctgccatggcaaagtgcaatgatcatagacactatgacgctgtagacttttacagtacaagaggaattacctggcttagacggatgataagagagactatatattaaaagcacacttcacgtaaaaaaagcatatccattacacatagttctctaagattcaaattcacagttcttgttcatttatgcacctttacagaactatagttctttaagtaaaaggtattttcataaacgtttcaattatgatagctttttttatttcctgtgccagaaaatattgattttcaggctgtttaatctcttataccatttagagacagagagaccaaacagacatataatttaaaagacaccagaaggaattggttgatctgtttttcaatcaaactttttctttcaaaagaaaaactgagtacctactatgggcagcacaccgtcatacacactggggatttactggtgagtccaacagattggtcatgctcttgtggaatgtactgtctacaaccatcatacacaaataaaagcaaagatctgctgttaatatactgatgaggctgaaactaaagtcaaagagaaaagaaaactcaacaagaaatgctatagttaaaaattaataaaagtaaatgcgagatttcaggatatatagagtccttttttaaaatgaggagtggcaatggttaaacaagttttttgtctgaaataacataatgtagagcacttatggggtttaatgtgtgtttgcatggaatgacgtggtcatggccctcagaatttggtaatgactgttgttggagaaatattactatttcgtcagctataatcactgacaaagggtgggaaagaatttgttctctctgtcttttttgttttgagcaattattatatgccagagactgcagtagggactttatagaattgccattgtatctatgcatttgtcctcgtattactgtaaagactgagcctcggagaatctaaaatgatatgcgagtgcaagaatgtgcacccagaactttctagttctacgttctgctcattctactgcaatagtaaaaaaaaaatgtttctgttcataagaatgattactgttttaggagtaatcatgaagttatttttatcatatataacccataattagaaatttagagattggtaggcttgtaggtttgtaggtaacatatgtagaaataattttttaacttgtttgtggacataattgttattcttaacttcagactgcaaaggttagagcctgagtcttgcatgcccattattaaaatgcatttcagttacacctctaaatacagttctctcccttattctaggggggtatgttccaaaacccccagtagattcctcatacctttgacagcaccaaagcctgcatgtagcatgttttttcctatacagacatacctctgataaaggttcatttataaataaggcccactacgcttgcatgttataaagtcaaataacgacaacttgaacacaaatgctgcactactgcaaccatgagtctgaaaagccatatggctactaagtgactaatgtagatagtgtgaatccactggacaaaggaatgattcatgtcctggctgggatggagtgggatggcgctagtcagaacagctagcaatttaaaacttatacattatttatttctgaaatttttcatttaatgttttcagacctcagtggaccacagttgaccttaggtaactgaaaccacagaaagtgaaactgcagatgaggagaacacgtgaaacatttaagagagtttatgttgacatgagaaaagtattcttgaaatatccacctcgacttcttcaaagtcttccctttgctctacgttctattgcctaaaatagttgtttaaatgatgcctaataaaaataaaaagaataccttaaatgagatgatgaccgttaatcttacattaagacaaaacaatcattcatgtttttaagcatcctgttcggggatcacaatatgaataaactatctagcagtaaattctatctctggcccagcaatgttatagaggatattaatatatatgtgtatatatacacatacatatatatgcatacacataaacatatacacatatatgtgagatatcattatgtgtcatgatactccttttcttcatggttgtccctttttattttgttgttgttattatatcttttttggcccactgtctcagatgtcataacccaaggtagttactcccaaacaaataataataacttccatttggacatcatcaacctcttggtgcatacaaatcaaagggtcaaaaacaagggtactcgttctcaagttgtaaaagatcactggttatacaaacacctttgtttagtgcagagaacgtggaataaggttacgccagagacagataaatagaaatcctccaggcaatggacctctacccatgttttccgtaagtcaacatgcctcctttttagaaacctgtttaaaattgccaaacataacacacattcagaaactggccaaaagtaaaatttacagctcaattctttatcgcaagaggaaaacctccaccactcccacagtgtccagagctagaacatttactaacacctctcactttcgtccctctctcccgctcaaaaacaaccagttccccgaatgccattagaacagctatcctgttcttctttttagtaacagtctgtggcacccaagataaactctgtagattccttcatcttaaatgcttcaatttacacaaaaggagtcatactccgtattctcttgtttctggtgttttgttcaatagtttgtttacacgatctacgcaagtttttgtctacagtaatagttcattattttttcgggctgtgatatatgaacacatttgtctcaatttattattatatgtttagtgattctactgtgtggtggttacagaatatccctggtaacctatgcacaaaaattggcataattgacactcgctgacgatccatttctatgatctctcttacatgatgtttatattcactaagccaacctctccctggagttccatcctcttcagagacattgtattctcccagcctctttatacttttcacctcgtataacttctcctcttcagagacattgtattctcccagcctctttataccttttcacctagtataacttctcttcagacacattgtattctcccagcctctttatacttttcacctcctacaacttctcccgcttctttctctcttgtggatgtcctctgggatttagttcatagatatctgctttttttctttccatgcatactaccctagataatttattctcacatctcagccatcacatctgtggcaatgaatacaatactaaccattactttcccttgatattttccatttacctgcttaacaaatacatttactttaaagatctcagtatagctcttgtatgcaaatttacttcccttccttccctctcttcacctttactaactttcttatttttctaatattcttgtcaatgcccatatcaacttcactttaacttcaaatgcatttattaaagttattcactaaaatctgatatttataacatacctactcgcaggggcgataaatataatgaagtaataatgtattccactgttgaccttttacagaattaatatctttgttttattattgccctcttatatgttatcgcttatccaccttgtttaaactagttgataaagtaactccttgaaagtcttgctggttcttgcaatttaccaagcaggaccttcagaatcactctttgtggaagagcagtttcgtctgtcagatgtgtgcatgcctcaataaagtaataagaacctgacccctctctgcagacttgcctgcttgtattgtaccaggaagagctcacacttccccatatgggcatctccctggttcttaatcccaagcgtttttcatgacgtcttttacctgggctgctttcttctttcctgtgcttatccagaatcccaagatttatttaagactcaccttgtttgtgaagtctttctgaggctcctcaattttctgtcttgctttcctttgatggcatcttcctgttggttttgtttctttatcttggtttaaatccctaaacagaaatgactgcattttaacatttcatttctgtgtcctttagcactttcatcagtgctgtattcttaagagatctgtactagatatttctatgcctgggtaattaattagaaaatgtttcaattacttttttttaattctaaggaatttagctttacagtttgtatagaaccactggccatgtgtatgtaatgttgagccctgtgatctaaatcattttcatcttcattgctattattttgacttctggggtgtagtaagcatagaaaccaaagacaattacccttagctgccaagtctccagggggaatctcggtaataactctgttagcttggccaacatcctcttctataaaatgaaggttgactacttttagagattacagttgatgcattcagagggcttagctaactgtctggaaccacaaagtaggtactcgataaacatgagctccctctttgcagataaaattagaaagaagtaactttattttaccttgacaacactattttgaatgaactattttataattgaatcatctttctgcaagtttcagtacgagtctggacattttctcctatccctccctaaaattcaatttaatttagtgatttaaatcaattttaaaattaaaagtttgaactaaaattcattttaaaaaattaaaaattaagtaaatgcctctgaagcatgcattaatattatgaactgatttagaaatatatacaaaaatatgcacatgctatataagattatataaatacataagaaataagttaacgtgtgtgtgtctaaatagttaaataaaatagaaatcaacctcactcacaaataaccttggaaacaagtagtttgtactttgatggaagctaagcaagagttgagtcagccaacaatcatcgttcaaccccgtctgctaagcattgggttagcattaacagtagaaagataactgcgtgtccctccccgattaggttactttaagtcccacaaaggacaaagtggattatttccatgtttgaggactaaaatagatgtataagcagggtatctcacacacatggaggacacttccagcagatgacaatgaagcctggggctgcgggacgtttactgtacttgtcattttacacgcagacgtcgctcctgttgtgtctttaggaaaccccacgggcagttgcaggtctgtgtccgtgagcttcttgaaggcaccatgcattcaaacgccaacaggatgcctgagcatttctacgactgcaccaaagaaaaagaaattatttttctaccgttgattctggacagctgtgcttgctaccaatctttctgctaagcttcagaccttacacatatttcttgcagaattgtttcggggagctttgtgctgaaaggagttgtgtatttttagcttgcacactatttatgctctgccttccctttaattggagtatggtaatttcctcactggggcacgagttcccattcttacctgtctttacttaaatgcctgcctttgcctaaatggcagcatccaccatgtgtactccactcatccgtctttcctccctgctcctcagtggagctactatatacagaacaagctggatttgggaaaggagactaaagagagatgacaggttataactgtgaaacacaattgggcctggaaaggttatgcataaattgaaaagcggttaatatttccccccaaaatacaatcattgacagcatttattaagaacttgatttttttgtagtgccaggccagtggctatataaatagatttactttgtcaagtgagagataatcgtttcaaaattccttgctttgggttgcaaagaagtaatgatattcaacatcatgatgaagatgagtttagaggaagtgatcatccaggagtagcacagtctggaggccaaggaaaggtaaaagaccacatgctctggaatattctactaaaagaaataccaaaaaactgagtcaagggctatagacaagctgtctgggatgtcactgctgctgaaatgtcgatggcgtctgtctagcagtactcacagaagcaggagaaagagacagagaggaaatgggtattttattttatttttgtaagtgtttcttttcaagccttattgtctccctttcgttttgtagctttgtaagctattagtttgcttcctccagcctctgtgcctgcgctctttgattcacaaaacaagcattaaatggtctggaaagcctgggaaagatctgtcctgatattgtaaaccttctgtgaactcatttttctaaaccttgattacccatcaaaagtccatgtctcaggatgtctcagctctaaggaaatgctttcaaaattactcccagctttgttccaggcaagtagctttttactcattttcagctgatgattgaatgcaagtgctgtgcctgctttgtcagagtggcaggataaagggagggggagaccaaaaggagctatgagacagggagaggaggaacaaaccaggaataacaataacaagagagccacaaggagcagagagaaggcaggaggcgaggcgaagttcaaaacagaggtcattcagccgtgttaacatactccctggtatattacccgacttacaagttccgcaaacggagattccacgttctcttggcttgccttccatagaatgtccaggcttttatgttttctttctgagatggcacatgaatctcatcagctctctccagccccctgtcaggatggactcctgcgctgctgatcactggaggcagtctgagcagaacctaaggagtcctttgatcctgaaccattgttcacacttcaatccaccttatcccagccacggactgctgtggtgcacagatagcaaaactcaggttgtttttttctctttgcaaaagtgaaaatgagcaggataaacatggaatttaaattttctcttcatagtatggtttcaaaggaattgcgagtcgacaaaactaggcattgctacttttctttaacttagctcatgtatgccaaaatttgattggcatcatttaagtggaacaaaagaaaaagaaaacagtgccaattaagaccacattaagtatctctgtaggaattacacgagtcgcagttgctgaaggccagactatttgcactttggagtacttagacctttggttcttgtcatttgccatatagaatttatcctaacctggggttaggagggtaagatggagcaaaaaacacagaaaaattaaatgaaatccacttacattaataattctaatatttgttgataaagaggctatgacaaatgttagctagaatgggctattaagaaagtatatttgaatgttaaaatatttagtggagatctcaccaaatcaacaatataactctcctataaggagggaagctaacctttcttgggccagataatttgatagtattttacttacatttttatctcatctattcttccacaaggtctgcagcatacattttaatatttgtgccctaaaaagcaattcttttttttctttttttctgagatggagtcttgctctgtcacccaggctagagtgcagtggcgagatactggctcactgcaacttctgcctcctgagttcaagcaattctcctacttcagcctcccgagtaggtgggattacaggcacacgtcaccaggcctagctaattttctgtatttttagtagagatggggtttcaccacgttggccatgctagtctcgaacccttgacttcgtgatccgcccgcctcagcctcccaaagtgctgggattacaggcgtgagccaccgtgcccagctgagaaatcattttgtattagtcacatttttatgacagcaatttatagttttcaggtagtttcccattattaatccttttataaaaatcccaggatttctcatgaaattctgggtaatgctaagtataatggaagtcccggttcctacctcacttgtttataataatgctgcctgttgtccatgtgttttagaagcagggtgaatagtgaatctggtttctttccttgtctccctgtccctagtgcttttctgccacgttctaagtgatctcttgttgcttttatttattttctccctctttagtacttcttttctttattttctccactgtttttttctgctgccttttaattatgtatatcactgcgtattttttcttctttcaatttgtcctaacaatgagaattttaagcttttgtttccatgtttcaggtagaattgctacctaccctgactctattttctaagtttattctctttcctagtctattttccacaaaattatagaaagatataatcatgatagagaataggtaatcaacaagacaatctatgcagccatttttgcatacttaacccaactgactggaattcaaaggcttctttttttttaatggcaggaatggtgatgaagatgccaagtaacaaaaatgtggatgaagcgaactttcttttaaaacccatagttagtgtaatttgtgaagttttattgacttgcattatttttaatccatagcccagataaatctccaataatgtttattagatagaagcaatttattgttgtaaaataaacgtaaaacttggatagaattgtcttcacatgaaagtataataatgttttcaagcaatatatgcgataaactaattgtagggaaactgacttgtgaatattaaaatagaaaatctattcatatttcactttagtaagtctcaaatgtcactgagcaattgcaatttaccatggccatgaaaataactactaacctacatgttttgtctatgaaagttataagaagaaagtaaatgacattcttcctttacgtttgttcagtttacatggaaatctgtttttggtaaggaagatagagctggtttcttaacatttatgtggctgacaggaatattggtttttgaaacaacaatatcttaccccagttttctctactctaactctcttcatttttctacacctccctttggaagccttgtgttgtccactagataggatgggacccaagaataccattcatgttccttcccccagggcctctgaggtcttctcctatatctatgtgtacatgcttaaggcatttgaagttaatcagtagaaccaagttgacctttttaaccaatttttaaaaattcaagtcagttgttagtgtctatcattttaatttcttggtctttgcttctttatatgaggtcagtcatggctggaactaaataaaaactgtgtcctgctgtgaatgatgtcctctagtggctcctcctcagcttagtaaatactattcttagggatagagttgattctatttaaattatttttaaatgttgaattattaggtttttgtttttgatattttaagatattcttttgaggtagagttgcactctctcactcgatctggagtacattggcacgctcatagctcactccagcatcaaattcctggcctcaagcaatctccccacctcagctagtagccgggactacaggtgcatgccccattgcctggctaatgttttaaaaatgttttcgtagagatgggatcccaatatgttacccagggtgttcttgaactcctggactcaagcaatcctcttgcctcagcctcccaaagtgttggcattacaggcgtgaaccaccagtcccgaccatcagtagctttagaatgtgtttgtatcagtagtaatcctttaccaaactaacaaccatcatttaggtgcctagttaagagtgaacatacacacacacgcacaaactctctctctcttaggattttaaaattaacttttaggaagaatgacaattatttgttaagacaatcttaaattattttacctaatatatttttgtgcttccaatgtaggtatataacgcttactgtcttaaggtgaagaatactattgctgcctttaaaaaaaaatctagtcttcttacggtaccagagcaggtcttccagaatacagatggttcagtatacttttataagcaaatgtattaacctcagaactgaaatatttaatattgatcttttttcttttggcctttattctgacacaaccttgatcttcagatcggaattgggtgttgagacttaactagactcaaatcaatttttaataagagttttcactgcctgtgacagtttcttccatctaattgatagcacaggcccatgttaaatgaaaaatgtatttttcaagcatgttctgtataacaaagtatgcatgagaagcagcatctggagtaaattactgtgtgctctgaataaggatcaagaactgtatggaaagagatttgtgtcccatagagttgcttgggtgttacctgtgcccatggtcagtttccatgggtctacatgtgacgactcattctcaaaaatccttttaccttcagttgtctacatattttgatcaaatataaatccaaaggcggcactagtgcttcatggacataattaaaccaaaatatttaatccctttactgaaaacgattatattgttttcacttctaaaaactagagcaaatcatgtgagaaatattataatgatcagatgtggtttaaaagaaatcaactttatatatactgaggaatctaagctcatgtttacttgtgatgtaaaatataatttgagttcaccttccgtagttttgccttttccagaatgtcagatatttggcatcctacagactgccttctttcacttagtaatatgtgtttaaattttctccttggatcacctgaggcgaggagtttgagaccatcctgggcaacataagaagatcccgtgtagacaaaacattaaatcgttagctgagcatgctcacatatgcctgtagtaccagctgctcaggaggctgaggtgggcagatcccttgaagtcagaggctgtagtgaactatgatcgcactcctgtgctctagcgtggacaatagcgtaagaccctgtatctaaaaagaataataaggaaaccatattttcttcatgtctttttgtgtcttgacaggtcgtttctttttttttcttttttttttgctgaataatattccactatgtggatgtaccatagtttatccattcatctattaatgaatgtcttggttacttccaatttttggcaattatgaataaagctgctataaatattttgtaaagattttgtgtgaacataacttttcaactcatttacataaagaccaaagaggacagttgctggatcgtacagtaagactgtgtttagctttgtaagaaactgccacttgtctgccaacgtgactctaccattctgcgttcccaccagcagtgagtgagccttcctgttgccccacaacctcaacagcatttggttgtgttgccattctggattttagcgattcttcattggtgtgtagtggtgtctcatgttctaaggacatgaggttgagcatcttttcatatgcttatttactctccttgtatcttttttcatgaggtgtctgttcagaccttttgcccactttttttaaacattgcaaaatcattttccaggagacagactatgaaatgtgggaggaaggaggtgaagttaccaaaatgatacaccaacaaaagtccatagctgtttaacatatcctttcacaggcagttttgctgaccttatcacagctagggcgtaaggttaactgtattgcaaacccagggctgatcgctataatggatgttgctagaaaatcctggacacgtgcgcccagacttgtccccttccagataaggctgcactccttggcacgtcaggcatctcctcttgggatcttccgtgatggtctctctaaattcatttctttcttctttttagtattgaagttgtatctatttattttaacttgtattttaagttcagcagtacatgtacagattgttacataggtaaacctgtgtcttgggggtttgttgtagagattatttcattgcccgcatattaagcctagtacccattaatagctcatgtcttattaggtcctggcaggcgaccgcctcaccacagccaggtaccataggagctgcctacatgtccctagcctcaatacactgtgagcctgtgaactcctccctgtggttcacataacagttctcttgtttcttctaaaactctcccttatccactcctgtgataagttatagtcctagaaaccactgctgtgctttgtgtgtattaaatcacgtcctgtaacactataagcaagaggataatgtgtttccgactttatttgtgagaaaacagaaacacctagaactgaattaatatgcccgacctagtggagctagtgcacaatctgaccctgggttatcctggcttctggcctctgttgtctcccatgcacctgaagttaagagtctcttatttgtctcttctgtatattaagaccattctgagcatgggtcaaatgggcatttttccctctcctgatttcagtctttgtttctttctcttgtttgtgatctccttgatgagaagaattctgcatctcatatccttagcatctatgacagttcatggaacgtggctggtgtttaaaaaatgtgatgaataaatatgtaatttaaattgttaaagtaattaatcagttgtcattaaaaaactaaaagttaaaaccaatagtagataggacagatgtgaaatacacattttattccttagaaactaagttaggggacattaagcaatggttgcacttacaagatatctgggctggatatggtggctcatgcctgtaatcccagcactttgggaggccgaagagagtggatcacgaggtcagcagttcaagatcaacctggccaagatggtgaaaccctgtctctactaagaatacacaaaattagctggctgcagtggcgggcacctgtaatcccagctacctgagaggctgaagcaggagaatcacttgaactcaggaggcagaggttgcagttagccaagatcctgccactgcactctagcctggtgacagagcaagactcggtctgaaaaaaaaaaaaaaaaaaaattggtacctgagtatcgtaaattgacctggaaagacagacaacaattttgtggcaaaggcaattggcattcacttcctgttgctacttaatgacgatcacagacatagtggcttaaagcagcatgaatgaatgatctcacggtgtctgtgggtcgtagtctgggcaaggcatggctgggcaccctgcttacgacctcacaaggctgcaagtcaggtggcagcctgactatgttctcctctcaggctttactaaagaaggatctgcttttcatggcaaacatctcacaccgcggcagctgcttcttccctgccagccagggtgtgagcagggagggtgctgcaatctcacctgccagatcaaacataggtgctcacacgcatgccgtcaccttagctccttgttgaccagaagcaagtcacaggccatgccacactaaagagaaggtatgactccagaaggcagggatggggagggtggcaccttcatagcctgtctgccacacaatcattgagagtaattctttacatattccaaccacctctcgtttctggtggggcatatggtgttcccctcagcacccattttatagtttttgaacatataaaaagactttgagcatcactttgaagaatggtaaatgttttggtggggattgcatgtgaaatatacatggatgtgtgtaagcaaacaacagcaaaatactcaaataagtttttccttatgcattgaatctttgagacattttcccagaactttctgcagctccttgcttattcttagaaaaaggagggcaccttaagtagaaaatatgtaagaagtatttagtagactgggtgcagtgtgtcacgcctgttatcccagcattttgggaggccgaggcaggtagatcacctgaggtcaggagtttgagaccagcctggccgacatggtgaaaccccgtctctactaaaaatacaaaaaattagctgtgtgtggtggcacgcacctgtattcccagctactcaggaggctgagacaggggaattgcttgaagctgggaggcggacgtgcagtgagccaagatcgcgccactgcacttcagcctgggtgaaagagcaagactcagtctcaaaaataaaaaaatgtttagtaattgctgaaggcatgcacattctgcaggaaaggatttctgtcgttttatcataaggacaggggaatcaggaaggaactggcgatctctttgcagagaggaaatatggacatagagtatttcctttttggatacgcaggacgcgggtcatagctgacttctgagggcccatttggtgctggggatgctgacagatgccacatatccacacttttcaccccccccaccgccatgattatgtaattctttggtgttcctttttagaggatgtaagggagtattttgctatagattggatgtgttaaagcacaggaattgaaagcagcaaatctggagataaatttttggggctctgctgccgactccaccagtttaaaaacattgtagaaatccaatgtttgattcagagtagggtgactactgtcaccactagtttattttgtgaatattcatttgagcatactacttcacctctgccctctgtaaaacagaggcaacgagatcaagccccccacaggttattgtgaggattaaacaagtttctatatgtcaagtgttcagaatacacttggatatcataagcactttacacatgttaactactcctgtggttatatgaagtagaggtctttcagggcatttcagctcccagggagtcttattcattttgagctgctgtaacaaaataccattaagttgttggattataaacaacataaacttatttctcacagttctggaagctgtaagtcgaagatcaaggtgccagcaaattcgatgtctggggagaccctgctttcttatttatagatggtgccttctagctgtgtcctcacatggcagagacagaaagagacaagggctccatcctcatgacctactcacctccagaaagccccatctcataatagcatcaccttaatgggtaggattttcacatatacatttcggagggacgcaaacattcagtctacgacacagggtttcatatcattcatttgattttcatttgtctatttaatccctcccaatcttaagtgtctggttttacagataaatggaaataaagacatgtttagcccttgttatctctctcttgcctaagttaattaatttttgtaagtatatttaggacattttctttagacgattaaggcagttagactgagtacactttatttttatatcctctaaacaggcattttggcaaaattttttaaatggacttaattattttacagaaaaatcctttttttgaaacaaaatcaagggtgtgccttatttctactttaattttgaaacttcacaatagcaaagacttggaaccaacccaaatgtccaacaatgatagactggattaagaaaatgtggcacatgtacaccatggaatactatgcagccataaaatatgatgacttcatgtcctttgtagggacatggatgaaattggaaatcagcattctcagtaatgtatcgcaagaacgaaaaaccaaacactgcatgttctcactcatagatgggaactgaacaatgagaacgcatggacacaggaaggggaacatcacactctggggactgttgtggggagaggggagggatagcattaggagatatacctaatgctaaatgacgagttaatgggtgcaccgcaccggcatggcacatgtatacatatgtaacaaaccggcacattgtgcacatgtaccctaaaacttaaagtataataataataataaaaaagaaagaaacttcatcattattacacattgcttgaaatagtgccttatatgatctggtattcttccttgaggctaagatggcaaaaagaaaaaaaattctccaacttaattagaaagcggaaagatattacaattctcttcagtggaactttgtttagcctcagcacctcgatgtggaaggcgtgtgtagccgtcagctgtgcatctctctctgtgagctaccatttaggaccctgcctgcttgacaagctttaattaaattctaattcccccttcttcttgctttttatcttaggtgcaacattgtgagcttgatgtgtaattaataacaatagccaagtggaacttttgcaggcacctttgcagcagagcagaggcagttttcaggatcgtttatcactcaggttcttcgtatcaggcagtggctttcttccatgaaggggaaccctctttgtacatttttctttgtatttcacttttgcttaattcaaagtggccaaacttcagtttccccatctatatgtatgtcacagtgtttaggtcactgagtcgtatttatataaataaagtttcagaaagatggacttcttatatatgcattgataagcttctgttatgcttacttcaaaaatattactaaacagataaaaatgtacaatataaacatcactaatttttaaaatctaaaactaatataaaggaagaaatatttttaaaatatatagtagttcacaactatattataattaaatataaatcatgttatgattcctggaagtaaaaatgagaaggagatatacatgtttaagatgcaacctggtagaatcgtcgcaaattactgttatttgtagctagggggataaaagctctatgtgcctatgtttgcgtgtgcgtatatatatatatatatatatatatatgtatgtatatatatatatatgtatgtatatatatatatatatatatgtatgtatatatatatatatatatgtatgtatatatatatatgtatgtatatatatatatatgtatgtatatatatatatatgtatgtatatatacatacatatatatgtatgatgaaagagaaagagaaatttaattttaatacttagatattattactttatgaagtcaggattgctagaaaaaaataattgctattacataaggagggattcacaagcagatcttccagtgtgtatcaatatcagagtgatgaactttgtggctacaaaataattgaaatgaacttcctggctgccaggaaatccacttcttactccctggtcagagtgaaatgtcaccataatggggtttttgacatttgcgtttatatgttgccacattttggaatttgccatttcttttgtcagtagcagatgcatttcagtatgtcaccaactttggaaaagtaaagccattggatttattgggattaagattatgtacttattttgggatttcttttgttaatttgttaacagcttgattttggtcagcctcatttacctgggctctgcgatagcatacaagatcaattttaatagtagaaagcattatccattttctagcttgaacatccatggatagaagtggcaagaaataaagtcacccaattataagaatattgccattccattaagggactattgatggtaagatcaggaactgaagaagcaggcttgctgcccagcccagacacatatttgaaggaacttgtgaatccatagaagcccttcctctctctgtgagagtcagtttatcaggccccgtctgtagggcaatggtttcatttggtgttaactcaagtgaaagacaaaaatgaagacaggttgtttgaagagtttggttggtaaaaatttcaactggggataaatgttctcagctgacaggcgttccaagcaagtttgaacatgatggtgcttcatcttttctcaagggatgaaaagtaggatcctagaggtgaagaagtattaaggacactctctttatacaaatcagtagacatctaaggaaatgcatacagcctatgccgaagaccttatttggaaaaacctgaatacagaccctctctcagcatctcctttctgtgtgggtagaaatgagtagaaaatgggaagaaagccatatgtcatagtgactctttcttttttttttttttttttttttttttttttttttttttttgaggcagagtctcactctgtcaaccaggttggagtgctggagtgcagtggcacgatctcggctcactgcaacctctgcctcccgggttcacgccattctcccgcctcagcctcccgagtagttgggactacaggcgcctgccaccatgcccggctaatttttttttgtattttttagtagagacggggtttcaccgtgttagccaggatggtctcgatctcctgacctcgtgatccgcccgtctctgcctcccaaagtgctgagattacaggcgtgagccatcgtgcccggtgacttttcctctttcaatatcttcccaggtagggaccatgcaggaagatgtgtctcactttccctctcatagagcaggtcacgtcagccctccaagttgatacctgagagagcgagtgatgaatctgtgtattcagtatgactctgagtgtggggtgttgtgagatggacttaccaaacttgcttaagatcccctgttctcttttgtgcctccttcaaattgcccaagtactgactgaaataaagaaggaaaacccccatccctctctgtgtcttctggttctgatatagttcgtgaatgagagagtgttcataatgtaagtaaaccccacctttctctttctctcaatgttaaaattttttaaatccagataacttagaaatgatcaggacagagggacaaaacaaaatgaaaccttgttcctagaagaaaatccttccatagaatttttgaaaacaatcagaaagcaaggttttttttttttttttcgtgtcatccaagctgcagtccaatcactccactgataagggaagcggcctccacaaatccttctagcctttgttgtggaacctcatgaccccagctctcctgtttaacagacaccctttcattttgaactgatgctgaggtattgcttggcagactaagaaatgtctaatgcagccctatcatccaacaggcaatgggatgtttctcccagggctgtgctctctccgaaaacgcaggactgtcaatgagagacaacgacattatacaacaaagtgagccatgatgcttggcctgaataagcaaaccctttcggttcatttttgacttactctaagtattgtgaaacacccagaaatattttgttattttctagagtttttgaaaccttcacaaaccaacccatattaataaaattttaaatggtaaaccagttcttaattatttattttgttcaggattattttctagaactgtttgaacctttctttttcttcatgacaagcaaaatcagtgcttttcttacaaaaatggattaaatatgtgtttagcccaaaaatcacattttgctgttttaaattagtcttagctgcacctatgcttgtattgaaaatgaatcacctatttgatttcaatatccttgagagaaaaccaatataagttttggtgtccttgtcactcatgtttgtatgactttcatacatcatacattattgctttatcgattagaagtctgttatattaaagcattggggttttctaaatggtaatgacttgtttttatctttagatgtaattagctagctttagaaaatgtagcagcattaagcaaaataatttatctactggtgtatttgttcattttcatgctgccgataaacacatatccgagactggtctattcccaaaagaaagaggtttattggactcacagttccacatggctggggaggcctcacagtcatggtggaaggtgaaaggcacttctcacttggtggtggcaagagagagaatgagaaccaagtgaaatggattaccccttatcaaaccatcggatctcatgagacttatccaccaccaggagaacagtatgggggagactgcccctgtcattcaattatctcccacaacacatgggaattatgggagtccaatccaagatgagatttcggtggggacgcagagccaaaccaatcaattgctaaactattttactacctaactccattactctattttcatttttgcatgttttatacctacgcctcccatacttactaaaaattaatatatttggaaaattttacatacatgcccctactttatgaagttccttaaaaaaacataaatagcaaattaagagttttagtattgatttgcatttctttaatgagatactgtctcacaccagtcagaatggctattttaaacaagtcaaaaaataacagatgctggcaaggttgtggctaaaaaggaatccttttacactgttggtgggagtgtaaattatttcagccattgtggaagacagtgtggaaactcctcaaagacctaaattcagaaataacattcaatccagcaatcccattactgggtgtatacccaaaggaatataaaacattctaccacaaagacacgtgcacatgtgtgttcattgcaacactattcacaatagcaaagacatggagtcaacctaaatgcccatcaataatagactgggtagagaaaatatggtacatacacaccatggagtactatgcagccataagaacaaataagatcatgtcctttgcaggagcatggatggagctggaggccattatccttagcaaactaactcaggaacagaaaaccgaataccgcatgttctcacttataaatgggagctgaatgaagagatcccatggacacacagagaggaacaacacacactgggggctataagggtggaggatgggagaagggagaggatctggaaaaataattactgggtacttggcttaatacttggggggtgaaataatctatacagcaaacccccatgacacaagtttacttatgtaacctgctcatgtacccctgaacttaaaagttttttaaaagagagttattgtattgctacctttgtatcaatgattttgtatacagtcataaaggtggccatggaagggtgtggcaggagaattcataaatctctggaaagacttgtactgataaagcctatataatatagcagctaagagtaatggatcataaagccaggcttctgcattctgttgtttccacacctcaagtcactttgatcaagctacttgatctcattgtgctacagtttcctgacttctaaaatagaagtaggtggagtacctacctcctgggattattaaaattaaacaagttaatcccattatgtgctcacaatagtctctggcatatactaggcacagtatctaatatttacttctttaagcttaaagaagtagtctaatatatggaacaaaccaaatagactgagtcctgaagcatttacaaggtctgtggactcaggtatttaacctcttggtgcttttatttcctcatgtgttaaagtttattttataaggattagatgagatcacacgtgaaaaatattagcttagtccgtcaccaaataaaaacaggttaattccttctctatctttaaaacagcaaatgagaagatatttgatcaaatctcatatgccttcccatgctgaacacatcattattttatctcccactaagaaaaaataaaacactgccaattcaactgtgatccaaggtctccttagcattgagatgtctcattttatatttattgaaataacccttttgatagattaagctatagactttaatgcattataattaaaaatgggaaagataagggtcagtgtgatagggctggcacagcaggaaaatgtgcatgggcacgtacaaatctaaatttggactcttaggtctgctgataggaaggtaaagctaaacaagcacaattgactataatctggaactgatgtgtattcggaatcttacatgtgtggctctcaagccttgagatgctcattgtaaataaggctggagtggaaaaggcagtttcctacttaggtgatatttagatatattcatatcttgtcactacttgggttgggagagaaatagaaacaaatagctgttttattgtgaaggtttcaaaaatcactgcaccaaagaatcacctggggaagactgttaataggtagatttctagggccagtcactaagatgatgaactcaacaactagggatgtaccccaggaatctagatctttaaccagggacccagggattaatgacaatggtgtgacaaaacctgaatgtggcagtcggcctcaggaaacacagctcaatattaattggttcctgagtcctcgtcttcaacatataatgcagtatattttgaaacctcaaaaaagtggattctataccaggtggttgtcagaaagagatggatacacagctacacaaggacccatagggagttagtaaatgcaagcctattttagagaatggcccacagacgtgtttgtttctcatgcattcttggttttgtaaggtgaagctaaaccgtgctgattgcagtaacaggacctccgcttgacgcatggtgcaaaaaggcggagaaatttccgtccaccaagtatctggttgtctaatacaactagctgaggcccctgcttttttatgagagtagaaggttatgctcgcaatagactcgagataaggatgttaacgcgctttacaaacttaaattaaggctcaaatattctagtgagaaatgtaattttctcagctaacaggtgaaccagtttctcaaaggctgcagaaacacacaggttaagtgatttgtgcaaattcatcctgggggtcaactcagagctaccctagacatgagaagtcctgctttttccttacagcagtaatttccttctcggtttttttttgtttttttttttttgtgagataacaatgcactctcgtggtattaggaaaatagtagaaaacagattctcaatgaaacagcacagaacaaagttccttttaactggtcatggttcagctacttcaaacttctctaacagaactcacgaccacattctccagggagaatgataggataagtatgtttgctttatccagtttgcttttttttgttgactttttatttttttttttttttgagacagagacttgctgtgtcacccaggctggaatgcagtggctccatctcggctcactgcaacctctgcctcccaggttcaagcaattctcctgcctcagcctcccgagtagctggaactaaaggagtgggcgccaccacgcctggctaatttttgtgttttcagtagagaacggggtttctctaattctcagtagagaattagcttctaaggaagctaatttttgtatttttagtagagacggggtttcaccatgttggccaggatggtctctctctcctgacctcgtggtctacccacctggatctcccaaagtgctgggattacaggcgtgagccactgcacccagctggaaagtcatttttaaagcagtcaactaaaattttagagaaaaatgttatttgtgctctggaagtgaaacgagtgatcaatgagtaaataagaggcaaaggtatttatgaaactactgagaatccattaaggtctttgttattttggttgtatggtaagttgcaccaaatatattgttttgttttgttttctggtttcttaattactgaagtgaaagctctacctgctaactataatcaattttgtaaccggacatatgtggtaaagtgcagctgttcaactgtataaaattcctttttcatacttaccaagaaaaacacattcacaagcaaacaaatgcaactttgatttattcctgagataatatgctggcaatattaatatgtaattccaggggtatcttctcagggctctgaagacatttcaaggttgtggacccattattatttatgtatttatttataaattaaccttattaaagaattgtaattttctctatgccagaaaatagatataactgtgtcttatttctttacacacgtaaacatttgaatagcattgagcccctgccatactctgtgttatcttccctaggaattgcaacagtgttttagtgtaggaattatcgttccttttgggggaattaataaactaaggttgagaaaatttccgtgaattaaggtcagtcaagtacaattgccagaaactaaattaaatttccatttgtctgctttttaagtctagccctgttttcaaaaatctaagtatggatgtcaaagcatatgaaatatgttgaaactattctccaaagaatatttaaatattttgaatgccattaaaatttgttacatattttatgaatttctatgagctaaggaaaaagtgtgcattttggagaagaatcagctttacaagtaaccagttaacatgcaccatggccatataaaattaacttgacattagaaaatttatagtttcctctctgatagtttataacgccctgccaataatactttcttttgcttcattattaatgtcgtttactatcatcaatatcggtacattaaatggaaggcagtgtattaaattttctttgatttatacatctactttcagtttttttgggggggaaagctaatgaagaaactattgattcaatttttatctaaaggcatttgtgacttactgacaagatatataactttacaaagtatttcaatactttggacttgtgtgtttcaaatcttaatatttcccagagcttagaagatgtaaaaataaattaaactgtcacatgaggcaactcatgttgctttgagttgctttttactattttcaaccttaggagcaaattgggaaataagcatttctaaggaagcttttcagtattaacatgaagtgaatcatttggcgagtgaaagaatataaaaagaggggaagaaggaaagtaagaaaattgcccatctttgctgttacaggcactaggcctgtgaacgtaacagccaggggtaggtcttatggccccataaaaaaacaggttaaaatcagttttaactcggggagtgctacagaggagatgaaagtgaatggtagtagaattcactgagttcccggtacttaacagttttctgcatggatagaaatggatggaatgcatgaatatttattgcatagctatcatgcgccaggcaaaaattgatcaggtatcaggttttgccaccagttataaatgaggattatgagattttcagaatttatgtccagttaaagcaaacaaaccaaaaatataatacagcacatactaaccaaatctgtagccaccttaataaaagttctcacttaaaatacagtattgtgagtaagaggtttggacaagaatggcttttggtatgtgcataattgacaaaggttgtttcagtctatcctttggggacatgccttgcgtcacttccagtacccagtcaacgatttcttagatatctcacagtgcctttctctgtgcagaagtcagtttaaataggaacttctcaactcgcaatttttaaaaaaagatgtacatttaaactgtgtgtgtcatagagcatcgtgtgaaaatgccaggccactcacgtaatgctgcattttaattatagtgattaaatataaatatctgaaaatcatgtgttttaccagactcagtttctgagccccccaattttgctcagcaccaagtccccgagactgatcgaggcgttgccgatggcttgtggagagcccctcggctgccatgacagcctaactccttccagcaccaacgcctcggcttccccacggtgaggaccagctcagcctccaccgtccacaccttagtgggagctgcagtggctctagccctaggtagctctgtcactgggagccctctcacctgggctgggctcagctggaggtgtctgcgcaggaagacagtgggataaggaagggtcacagaatgcccactggataaactgtgactcttaagagacaggtggtgggaaggagtgctcacacctgctcttccctctccctgacacagctgcaaggctggggtcccaccagccctgcgggagggaaatccctgtaaccacagccacctgtccatcctaggcagccagcaattggcattcagcagcacacctcatgcttttctttacctaccttccctgcttcatttctttctcttttcacccttgattccctgggatttttccttcacaaaaaagcctgtagtttatgttttgactgaagcttttttcgtaaggaatccagggaagtacggtgatgggttttgatggaggacttcatgtgtcaggtgctctctgtgccatctaatccttacatatgaacaaacggaggtatagaaattaagaaagctattcataaagtgagtggtgaaatcgggacttgaactggcatttgacctgggagtccacagccttgggatggtgttagactatgagttgctatttctaaaggcagtctcaaaccctcagtgttttactaaaagtgttgtggagacctatttgattatgttttattttaaaatccctttctgttttataaatacatattttagaactccgaaaagtagtgatgatgttcaatttcagtattaattcagatgagtattcccaaattatatgattttaccatatgtatatatgactacatttaaaagaagctgaattaatcacacttaactaccaaaattccaaaatgtaaagccaaaattgtgctgaatactaataccatattcttatgatcctaaatttgacatgtgaaatttcgtgttagaatagatacatgcttataaacatccggtctctatcatgatgaataaaaagtataatatcttctagcatatctttttttaaaaaagttttattttctgttaaaaagaaattatcagttatgctggtgaagcaaactatattttaattggaagattacacaagagacttttaatagttaatgtaacttgtttataaatttaatctattatgtattaaatatatataattaaattgaaaaaatcacactgtcttaaccagaaattttctaaataatacattgcttttgtctgctgattaattacggaaaatgaaagatatgactgtgcaaataaacaaaaatacagacaacaaaatgaaaccaacagcaataacaccaacaaagtataataaaagagccaggtgaggtggctcaagcctgtaattccagcactttcggagcgtaaggcaggtggatcacctgaggtcaggagtttgagaccagcctggtcaacataatgaaatcccatctgtactaaaaatacaaaaattagctgtgtgtggtggtgcacgcctgtaatcccagctactcgggaggctgatgcaggagaatcccttgaacccagaggcagctgcagtgagctgagatcatgccactgcactccagcctgggtgacaaagggcgactccgtctcgaagaaaagaaaaaagaaaaagaaaaagaaaaaaaaccctaagaaaagaacgttgtgcctgggtggtatttaagacgtataggttgcaagatagatgaaactttctagttatctctgagtccatgtttttctctaaaaaacacaattctgggttctctgtatcgagaatcaaatggggttgccttccatatgatgccacaggtgaatattaaaaaagagaaacactcaacaagttttcaggatcataacacatttgatattgttcatacattaactctttattaatatactgcttctgtcttatgaagctatcacaatttggagacatgcttgtaatatttagatttcaaactattatggatatagaaatggagtgagagagggagggaggaaatagataaacagtattgaatgccatccacaacttttaagatatatattcacagccctgtattataggcaaccataatcatatcaataggcttgcttaatactagcctaaacataataaagcatcctaaaacacatatccatttttcaaatgcttaaaaataaatacagttaatccttgaataacacagaggttaggacactgaccccttatgcattgaaaaatccacataaaactttcaactcccccaaaacgtaattactaacagcctgtagttgaccaggaatcttacagataacacaaaccgtcaattaacacattttgtatgttatatgtatagtcttacaagaaagtaagctagagaaaataatgttaagaaagtcataaggaagagaaaatatatttactattgattaagtggaaggggtcacaaaattcttcctcctcatggtcttcatgctgagtaggctggggaggagaaacaggaggtgtggtatttgctgtctccggatggcagagggagaagaaagtccacgtgggagtaaactgctcagttgagatccacgttgttgttcaacgtcaactgtgtaagagtttactctgtaattcctgagggcacccaggaatgggttacgtagtagctcacacagaaacaccgcctaaaggttctctttagagctctcactctcaaaagtgctaaaccccatgacatctgctcaaagtttgtactaatctgctctctaagactgcagcccttagcaactttgattttccattttcagtctctctccattctacagaatttctttttcacttctatgaccctctgcctttcttagaccaattctctgtcctcctcttattctaatcagctcaagttagacaacaccagcataaaatcttccttataatgtctgagtggtatgttttttttctatttggaacgttaatctgtcaccttgctgaactatttataaacataaacataatttaaatttatgtctcgtgttatacctataataaacaacttgtaggccgttcttacatttaaattttcacttacgaagattatttccatgtgtggaaattgtgttgtaaggcaggcaaatttatcattttcaatctctctagtttctttttgtgtatgttcgtttagattgtaattgcatacattatacgtttgcatatatttgcttttatttctttgatagtatctcttatttaatggattgggtctttctgaaattaattttttgtgtctcttttgacacaggtacctaaatcctccccccagtagaaaaccatttgctttaatattatttattgattagtttgttctttttcactgatttgaaaagctacctctctcatatattaaattcttatatatgctacgatcatttgcgtgttcctatttgacaattctatctctatttttctgtcattttataagataataggttaaaagaaaacccaaagccatttggttgaaaagaaactaacatttatgtgttactacatgctacacattcctgcataccttacatcatttaattttgacagttacctagagtcatatgctctttgttttcacagataaaggaaactaaactccccaagtttaggtaaagtgatgtacaatgtcatcttgtccgtatttgtgcataactactattgatatggagaggcagaagtacaagaaaaaggcatagcctaattgcaaagcaggtgcaagaggggagtgggggttctttggatttgcagacactgggtattactttgtgaaatccttgcttatgaaacaaaataatactcaggtaagctgactggattaaagactacctacaatgagaatggggtaagccagccactttctcaacctcagataccccaatggcatcaggttgtctctgctgattttccctccttttgtgttaagaactcacattgattgtcatatttctaaatccgaaaatgtaaccatgagagtttacaattttacaaaatggcttaaaatttaaaactttttaatcatttataattgaaattttaagtcgtcattggtttggaaaatcattggaattttaaaatctatattccaggaatttactataaggttgtaattatctaaattcaaacacaagtagagaaaatgttacataattcaggcccatatcctaaaatatcacttaatgcagaatttgaatattttgacttgtttgaggaatttaaacaatataatttatgtgtacatataaaaataatatatatgaaatataaataggtaatgttactgtagatttacatagaatggagtgtaaattatcaaaatattatggcaaaaatttctactataatttttctaaaagtgaataactatgtttaatcatatgtcatcacacttacagaaagggtatatataccaaattttttaagtatctaagatcaatgatattgaatggtattttaaaataactttctatattaaaagaagtgaacgtccacagttatgaaagtaaaagtgctgtttacacctaatatgctcatttcaatattttcttgatataacaaagcaattaatattttataaattatttgtttaaaattatttttcttattgtttgcagaatatcttgttaaatattttaacttttcaaagtgatgatgaataactttctaatagctattctttggaatataattctaaatactgttttggtatttccttttattttttacaaagcataaataaggttccccgggtccctctcattttattcatctgttattaccttaaatatatgtctataaatgacatatacctttaaaataaaagtattaagagactacagtgaagcactgttactacagatcaagtgatggatgaaataaaccaggtacatacatgctttctctactattggtaagttgtcaagtaaaaattagagctttacttttttaattattagaagagactgcatctgaggctgtgcaaaagtgtaagaactattcgattttaaaataatttttgagatttcctaaataagagaaaaaataacattttaataaaagtaaaattaatatttaaaaagtatgacaatcaagacacatcgatattgaagaaagaattaaagcattctttagaacagatctctgctgactgtgtcgaacaagtttcccagctaagcattaaatctgagttccaattatttctagttaaaaaattggaagaaatgttgattcttagggttagagcagataatacgtatcgcttagaaggcttcctattcactgttttgcaccctctataaagtccctgttatttcctaatcattggaaacacctttgtagcctacccactggaaacaccattttttgtagcctaatcattgaaaacaccttccttgcagcgtagtcattagacacacctgccagcttcctgttaacatctatatattgctcctcagtctcctttgtgacgctaaagaaatgggtctaacttcttttctccgcgtgtttgctgcatttttctttgaagatgggtcgtgttctctctgcgttcgctggccttcctcaaccagggtgagcattcccagttctttccaaccagtcgccgcagagttaggtgtaatgttctgggttgttttctccctgcacctctctctaaaacgggccttcgttattaaacaccatgcactggttctaattcttaagcagaagtgccgtcctgtgaccacccagacactgagccatgttttgttaggcacatgcatcttgtgaatgattttgtcgagaggcttgctgacagctacgtgctgcacttgggtaatctacctgtataggaaccttgtcaaaatagtaaattagaaatagtctaacccaatgtcttctagaaataagctgcgatatagtgatcactattgccttttccagctttttaccaacctgtttgactttgttgtgaaatttattgttcctgatttttttaagtaggacaccattttgtgagcttggggaacacgagactttttctaagattgtttttccataataatgttgttggaattaaatccagtaaggcctggcatgtgataatggttctgttctgttgaaggataattttaaaaattaaacatttcacacaaatacaaaacaaatatgtcaaagattttaactgatttattaatgaggaaattagaccttgcaagttcaaaagatatttcatagaatcctcgtacataaaaagtatgtaatgctcaaatatatttaaaagacactgaattgacatgtcacttgagggaaatcccaaaaatacttatttacacattcatactaaacaatcatttacattaagagttacttaaaaataattcagttttacataactcaaaaaaaatcaaagaagcccagagacaacatcgattcagataacctgtaagaatgtgttagacaatccttaaatattgtctaaataatctgggtccaattaagtcattcatggtgtttttctgtgttcattttacctttcttctttttgtctttactctttcgtaccattctttttcaaaaagcactaatggccgtttagaaatctcactgttgaaatggttaacgtacaggaaagccatttatgagctcttagaccagtgtttggcagttatattatttggttgtacattcactctgaatcctttggcatgtcatttttgtctgagttcatttaatgtaaggaattccgtgtttgatgcacttatccttccagttaagcattgagctgccgaccatgaccccaacctgtctacatagcagcactatcacttctgtgaagaaattgtcaggtgataattctacagataaaaataagagggaagagagaggaagcattgggagttgaaccatcgtagtcaagtgacgccacgttgtagaaactagcatgaaataaaggttgaaggagaggagggagaaggctcgggatagaggaggagcccctgatgggaaatggacctggcagggctgaaaaatatcagaggccagaggaggcaggtgaaggatcacaatggagaggaatagatgaggttatgaaaaccaaaggccacctgtaatcccagccctttgggaggccgaggcgggcggatcacgagatcaggagatcgagaccatcctggctaacacggtgaaaccccatctctactaaaaatacaaaaagaaattagccgggcatgttagcgggcgcctgtaatcccagctactcgggaggctgaggcaggatgatggtgtgaatccaggaggtggagcttgcagtgagccgagatcacaccactgcactccagccagggcgacagagcgacactccgtctcaaataaaaaaaaaaaaaggaaaaccaaaggccagatcacgtaggtgtgcgagtcattttaaggactttgggttccctccgtgagaaggctgtaagcagaggagtgctgtcgcctggcatattccaagggctccttccattgcctcctgtgcagagatgtagagggacaagggcaaaagtggtgacgttaggcctgtgatgacaagagttccctgggcctgtttccagacgaggtggggagacactggcctctaagctacattagggatgtcaggaatacacagagtcaaagaccactccaaggtgtttgcacaagctactgaaagaataggtttgccgttaattgagaagaggaaggctccggaaggaataggtttggttctaggtaaaatctactcacctgttttgatctgaattggttctctaaatgtagccaataacacaatttgcagtcccagatgatacttgtaatctgaaaatacggcagaatgctgacaccagccgttttgcaccttgatttggttcacgtggacaaggtaaaataacaagacttttcagaaagccgaaaataattgttagaatgagaaagtcccactgactatgacaatcatagtgtctttgctgcagcctgacccctgagctccttttatgagctttcctttccttaggtcttggccttggagaggtaatttctaggtccctgccactgatgtgtatttgtctttaagtaagtagtgccttcttccattttcctaccaaaagagctccagggaggccacaccaaactcttcaaacaggtcttctgtgtaagacacaattgtgctcttgttattaaaatttcatttagagagtatagcattgtcttttgaactttttttccttttagagtctctgataagagaactatacccatctcacatcatgctcttgaaggtctgtaaggagtcaaacagaatgagcttgtttccagcattcctttcctattagccaaaatattctaaaattccttgcagtgttcaagtttataattagcttaattgataattcaattgctgtttgggctaaattcaatacaataattattgattatccattatatgaaaaacacaggacatgctaagctgattcagacatagaagcaagcccagagtaggctctccctaagcaatgtttttgaattatgctaaacactcttgttatgatacatacagtccaggggaggagatctacctaggtttagtaggatatggaccattttaacaattaggttcaaattgaatcttgaaaaatcatttgtggctgaatggatgaatcaaggaaggaggatttagctggggacaagagtgtgtaaatgccttcatgtaagaagaaatagaaaagtacatgttcagaggataagaatgagttggtatatcaagagcttaaatcataaggtttgaagttttggcctgagtctcatcaaagtaggtgttgtctaccctgctaaaggtttaaaatcaaaatattatcctctttattaatggtttttaaaaggttttgtgataacacctttaaaaaggcctatcgcccagtcaataacagaagatcaacactttctcaagttccttgggtgaaggtggggtcaggagtctcagaagtcagccagctctccttcctttccccaggcatgccccaggcactgctgctttctcaacttacacagcgtgacaagtgctgttagagcacagaaaatagagagctgtaggctttttttagtcaaaaagttatatctgaattttagaaagcggttcatcagaacagtgcagatcaatttcagaagacagggacggacaggaggcagggcctgttgagtaacccatgtgagagatggggttatcactacacaaatctacagcttaggacagggtccttagtcaagccttgtaaaccatcatattactttgttagttcaggaatggaattccaactgtttggatcccaaaaaccagtgttcaacccactagatgattctgtttttttggaactccttttcactgacttttgtccaattatttcattgagtttgtccaattatttcactagttctttccccatataagaaatagtaaatgcaaggtgctttctacggtaaatattttgttagctttagctttaccattgggcttgagatttttttaaaaagataatagcttgtccaaccctatttgcaccttgatttggttcatgtggacaagaaaggtaaaacaagatatttcagaaaactgaaaagaattgttataatgcactgactcttgaaaagggagaaaatatttgtttcttaaaataacaatttttcaacaggtttaatgtgctaagtaaagaaaaaagttgtctgtgcttaagtcagaactctatcctctggccactcatgggtggcacaaagacagccaagattaacggtttagaaggatgtctgcttggtagtctaagacggaaaaagagaaaaatggaggagatgagcagggaatgaggacatttgaattgatccaggtgcaggaattacacattcagtaatgggtcaattaaataatctgtatagtgactcctcctttccttgccatgaattggtttaattgaacacgaattgaagtagattcttagctggaatgtgtccctgggagctttgtgcagacacaaggaaactgttaaggactttgaacattgtttacagaacgagttgtcaacatttgttttttctttttttttcttttttttttttttttttactctgaagaatctagagcaagactaagttgaaatttgaaaagaaatcaaagctaatcacttcttttaattgttctgccatgaaacagacttttgttgcctttgaggccagttgagctatgttgagaaagctcccacagctgagcatttccttacagctaagggaaggaagaaatgttcacaggaaattctaatttcaatgctgtaaaaacacactgtaaaatttcaatataattaaaaataaccttagtctcatcgctgaagtcatcttggaataatgtttcccctgctctctgaatttaaattttaaatggcttgttatttttctatggatttcagttggtggtattctcatattataatttgataaatatagtattattggaaatatgtatttgttgtacaccattttaaaatttttaaaaagctgggactggagaacatatcccaactcagagttatatttgttctgaaaaattaaacatttaaataaagtcaaaaaattgaactggcttatgaactcttagaataactaaactttgtgacactgttggcatttgtttgcccatttttgctcatggttttccaaacacagctttccattgccttctaaacaataaacttcaacatttgttcaatatataggctaaatttccttgcctatatattgagtatatatatactcatttgaagacaatatcaaagtgagtgttttttttggctttgttttttcttcaactccccgatacatctccatggctagtccttgtcaacctctgtcaacttttcttccctttctttcttccctcttctgtttctcctcctcctcctctgttttcttcctcatcaagcttattcttccactgatctgtggttatctgggaaggatagccaggagagatccctgtctcactattataaaagcatcatgcccaatcttaaacagctcttaagaccacggagtaagactctctcacaatatttcattctttataaaactatcctcccatttactcgagagctggtgtcatgatatttaatctctccataacttgtttgacttgtgttatcattggatggtaataaaagtaatttgtcaatccaaatgtgattgcacatctttaatgtctcagtcttttcccatctgtccttgtctctcccacaaggtattggaagcacataatttctctactgacttttccttcttctatggctgtgagtttgttagtgcagtgagtcagccacttccagatacaatcacctgtgaagaggatagaatgtgtggcttgagatacttcaggaatgtggggtgggttggcagtaaagtacccataaccacccccattctcagaggtgagaaaataatagatgacctacaaactagagttcctccaaacaccagcatcctttcctaccattcttcttcctttaatggtcagagcaataaagtgaatttcatctctccagtacttgggatttggaaatcttgttctactgaggccttaacttaataatcctcaacgtctgacttctaagtggcctgctgaaaaacaggcattgctttacttgacttccattctgagagtggagttgtatgtgcttccatatcccccactgttaagtcacctcttgggaggacgacgaaccatcttggtattttaaaataatatggcaaggcaggatggtgtcaatggtgaacgtacaaggctccttcagcatgatgaaatagactttcaaaccatgttttctcatttatctttagtagacatgtactgatgtacactttttgcaagcacagggaccgtcatcttcaccaagacatcctagtgtctgggttagcacctgggtcacaggcactggaaaaaaagatgaaagagacacatactcaaacttcagagcaaatgtgtatactttatgtggcatcctcctggtttggacttcctattccctctggtgacataaagtgacatagtttgggggtaatattctgagccttagatgggaaaattaactgttagtgtctcccagtgaaaaccgttccgtttcaggtaaactgagtctgaaatgctcggccttgttgtgtttcccttttttcctattttcttcctttcccaaggtagctcctgggttcaggaaaaagaagtcattctggtggcatcatgagtgggaggaagcacatctggtttgaatatggcttcgtgctcagccccaatggagaggctaataaaactaataaaaactaataaaaaactaataaaactaacacagcagggtaaattgggatcatagatactttcctcccaaaacttcaaagagaatcagttttcttgatctctcagcccagccccaccccactcagcaggactcgccttaaagcaacggatgctgatgatccaatcagtgtagatacattaaaacacaacaatacagagtttggctatattacaggattgactacaggcggcccctgacttaccatggttcaacttgggactcttacccttttacaatagcgtgaaagtaataacacgttcagtagaaaccacccgttgagtacccatacgaccattctgcttttcacttttagttcaatattgaataaatgacacgagatactcaatgtgttattataaaataagctttgacttaggtggttttcccagctgtaggctaatgtgcgtgttctgagtgtgtttaaggtaggcaaggctaagctacaatgttttgcaggttaggtatattaaatgcattttcatcactcttttcagcttacaatgtttttattagaacataaccgcactgtaagttgaagagcgtctgtccattgcatgcatacataataatgccctgtgcttcatacaatcactgcaggaagatgttaatgtgggaatgttaagaggcagtgaaatccaaactgggtcttggaaggctaaattagagtcctgtaagtgaagtagagaggaagtagaattccagctggagggataagccttcgactcaaggttctgagctctatctcattcttttagaaaactgagaaacctgtttctttcagtcttcttaccatattcctttttttttaattcgtaaactgaattaatataggtgtcatgtgatataacaggaaatgagacttatagctaaatggaatttcaatatcccatattgcgctctgttctctagtcctgagctgctgctttcttttaatcagagctatattgaaatgattcacataccacaatattgacctgaagtgtactcttcagtgctttttaatatattcctggggttatgcattcatcaccacagttatttttggaagatgtttaatgcaaaaaacccagtatccattagtacccactcactattttccctcagccccacggcccaaaggaaacactaatttattttcgtctctagggattggcctattctggacatttaatgtaagtgcaatggtacaaaatgtgttttgtgactagctctttccatttagtaggttttcaaggtttgtcaggttgtggaataaatcggcagttcacttcttctgtatttctggatcctatttaatatgatggatatagaccatgttttttcatcggttgactgacatttgtattgtttccactttttgcaattatgaataactctgctataaccatttgcatacaaatttttacgtggacacattttaagtatagaactagctgtggatttgctggttcatatggcaatgttatgtcgaacttccggagtattttacaaaatagacgcaccattctatattctcaccagccatagggaagtgaaacacccatacacctcctcaccaacacttactaactgtctttttgatggtacctattttagtggacatgaactggtatctcagtacgtctttgatttgcatttccttgatggctaaggatgctgagaatttttatacgggcttcttggccatttgtgtatcttctttggggcagcgtctattcgattattgtgcccatacttggtaatttgtctttttattgctgagttttaagagatctttatgtattccagatgcaagttatttatattttatataatttgcaaactttccctattctatagatctttttctgttctaatgttttttgaaatacaaagtttaaaattttgatgaattccagttaattcttttcttgtgcttttgatgtcatatctaagaagactttgcttaacatcaggttacaaagatttactcctatattttcttcaaagagtttgagctgcacttcttacatttgggtctatgatttatcaatttttttgtggatagtgtaaggaaggggtaccctcttgtggatactcagttgtctgagcaccatttattgaaaaactatttttttcttgattgttttggcatcttgtcaaaaatcaaattgacgggtaatgtcagtggtttttatctctggaacgtgaattttatttcattaatccatgtgtctaatgcaagcataatggaatcatgatcaatgcggtttcctagaaagtgctgaatcaggtaggtatgaatattgaaatttttcttttttaaagattgttttgagtattctaagtcctttgaatatccatatgcattttaggatcagcttgttaatgtacgcaaataagccagcagagattttaataggaattatgttaaatttgctaatcaatttggggagtattgccatcttatctatattaagtcttctgattcatgtacatgaaatatttttccatttatttaggtcttcaatttctttaaacacttatagtttttggaatatatattttgtacttattttgttaaatttattcctaattattttggagtttttagatgctatggtaaagggattgttttctttttaaatttcatgttcagcttattactattgtggataaatacaattgctttttgtggctgagtgtggtggctcacacctgtaatcccagcactttgagaggccaaggtgggaggatcccttgagcccaggagtttgagaccagcctgtgcaacacagtgagacttcatccctataaaaaataagattagcagccagacgtggtggctcagcctgtaatcccagcaatttgggaggccgaggtgggcggatcaggaggtcgggagatagagcccatcctggctaacatgatgaaaccccgtctcttctaaaaatacagaaaaattagccgggcgtggtggcgggctcctgtagtccgagctactcgggaggctgaggcaggagaatggcgggaaccccgtaggtggagcttgcagtgagctgagatcgtactactgcactccagcctgggtgacagagcgagactccatctccaaaaaaaaaaaaaaaataagtaaataaataataaataagatgagctggctatggtggtgtttgcccatggccccagctatacagcaggctgaggtgggaggattgcttgagcccaggaggtacacgatgcagtgggctgagattgtaccactgcatttcagactgggcaacgggatgatgtatcccccaacaccccacccccacccaccaaaaaaaaatatggatttttgcatattcatcttctactctgtaaccttgctggagatgttcttaaattctaatagtttttaatggatatctaagatgttctgtatactagatcatgtgatttgtaaatagttatatttttatcttctttacctatctttatgcctttaaatttcctgcatcactgccctagctaaaacctccagtatgctgtggaatagaatttgtcttattgctgattttaggcagaaaatgttcaatatttcattaaatacaatgttaactgtaggcttttcgcaggtgacttttatcaggttgaagaaattccccattgctagttaattgtttttatcatcaaagaatgttgaattttgtcactttttatctggtaagacaatcagctgactttattttattgttatggcacagtgttagattttcagatgctaagcctatcttgcattcctgagataaatagcacttggacacagtatataatgctttatatgttgttggatctgaatttcttgatttgttttgagcatttttgtgttcatattcttaagaaatactagtctgtagtttctatctataactatgtctggctttgatattggggtattgaccttataaaataagttggaatgtgatccctcttctatttttggaaagaatttattaaagactgacaataattctactctcaatgtttggtagaattcaccagtgaagccatttgagcctggaattttctttagcataattttaaaattactacctttacttgaggtctattctgatgttgtttgacttaagttttgggtaatttgtatttttgtagtcatccagtttgttgactaccagatgtttataaaattctcttacagtcttcttcttaaatatctgtaaggtccatagtaatattctctacctttttttcccccattttagtaatttgagacttctttatttcttgaacagtctagcaaaagattcttaattttgtagaaggtttaaaaatttctttgaatttgcttacgttcatttttttctattgtatacttgattattctcactagaatatttgttattctgcttaccgtaagtttagcttgtactttttccaggacagtgaggtggaaggtgaggctatttatgtaagattttttctttttaaatatagttatttactactctaaatttccctctatgcaattcttcagttgcatttcatacattttgatgtatttgatctccattttcgttcatattatttttaaatttccctagtgatttctttaactcctttgggtttttagaaatttttttaacttccacgtattctattatttctcaaattctaattttcttgcattgagctcagataatttatttatataatttcactcattttaaataaactgaaagtagttctgtggcatggcatatgctctgttgtggagaatgtttcatacgcccttgaaaacaatattctgttattggctggaatgttctgtagatgtctgttcattccagttggtttatagtactattttggttgtctagtctgatggtcattttggctagattgttctgttcctctatgaaaatgagtagaacagtcattattgtttgattgtttatttggcatgcaattttgtcaggttctgttttatatattttgaggctctggtaggggcatgctttagttatctaggcccagtgacacaaagtaccacaaattgtatggttttaaacagcaaaaattaattttctcatagttctggaggctagaggctgaatcactaataaatttccacctgattgcttcattatttctgaacttgctctgggctccatattcttatgtccacacttctttgcaggagatatttttgaggccaggctttgaggtttgttctaacccacaatgcgatcttcttctctgtctcttattatcttagactagccattccatggattagcctgcagctctagtgaaagcaccaggctcctctaaattgcttatcctcacaatttccatttatttttgagagcaaccttggatttgaatttcctgccctctatctctcctcttgggaaaaatctctgagccactgcttcagacgtggggcagagacactctcagcttctgctggactgacattcttgtttcatgagtaaaccacgggtctgaggtgagagcttgattgtcttggtttgctcctggtggcatagaaccttcaccttatatgccatctggtgcacaagtgacaggaactgcagcattttgaccttttattctggagttgagcctcccatacctcctacataggtggaacttgaaagcgacatggcctgttggccaaactcatctgcagtttatcctttgcctatgaagcttgtgaggatgagaaaggatggtggcctgaccctcctggttagaagcgtaccctggctggaatctgcaggtagagagaatctagttttcctggccatactcacctagattggagataaggggaagaaagcaggctgtggcccaagctgcacaaacgtgaatcctcactgagatgttcttggttagatgtttcctcgttggtttacaagcttaatgcacttccagaaacttaaatatttttaatacattctccacccattgtgcttgtttcactgtggaatgagtattcagtgctacgcttgcctcagttctgaaagtgggtctttggatctaattgaaaagttgttaaaaaaaattaaatattcctaaccgttatcttattcaatgcataaaatgtttttgtaagtaacaaaaggagaatatttttcccactaataaagaaataatctaattattttgctgcagttttggttagtttcagacaaggacctttgagaatacaaaatacattctcattgattttgctgctgaggtgtgggtgatgatttttcttttttttccttgtatttactgttacaatgtctttcaaagagtaacagttaacattaagaaaatacatacctctttcacactatacagaattttcatctatttctcataatatgcatgcttagcaatagtagttacacataactttaacttcagactgttttagaaaccaactgataaaaatcactgccaataatccccataaacttgtaataactttaggtttataaattaatttcattattatgattactgatataactttcagctaatcgatcccttgtgcgcacacaaaaaaaaagagggagaaagatatttctcattgagtgtcattttttgtggttactctgcaaccatttaagtgtgaccgatcattataagttccatatttctttacaaggtgattagtatcattttgatatttagtatattaatcagcatccactcaagacagcaaaaccataaagtaatttaaacacagaaagtttcatgtaaagaaatattaagtatataaggagttaaaaacatgaaggattgtgtacctcaggggtaaaaggaattttaaagaatagaggaataccggatatagggagaagtcactacctctcaggggaagtgccaccaaccaaagaagtacatctgggtttttctgcctgggttgacatacatagactctgccccatggtgtatgggaaaatggagacgttcactacggtgctgcatcaagctgtcccaggggaggtgccaagcctcggaagtcactgcaaagctgtctgcaagggtgctgaggtggtgagaagccagctaagagggacttgggagaagcagccagtgaagaggtgtcctatgctgctggatcccatacagaggagcacatgaaggaccgggaagggaagctgcctctcccatgtgaacctctagtgctcttcattgtctgagcttaacatcatgctatttgaaaataaatatttatgatgattggctccattatgattaagtagcaatgtagggtgcatttgaagctcagagacaataaattaacaggcccatctagtataaaattgaaattttcttaattacatgggtatgtccagatgatcatttcttatagaaaactacaggtaatcttttccaataagcaagacttttcaatgcattatgtttgttttttccctgtcactcccctgagtttagtaaacattcccttcctgttccagacctcgggaagccccaatcacttcttcctccgcaaacccctctccggtgtcccaagcactctacaaattcaaaagtagtcttagaaagatgcaattcaaatgatatatgtaagtaagatgggcaaacaggtaaaaccacttggttgagaatgggaaagatgagttccccccttccctccacatgtgtttaacaggacacatttcacatctaggtccgtaaaacccaaatcatggtatcaaaaggtataggaataactctttcacagtaagaaacacatcgatagtcatattatttttctctgtgccagacacacctggtatggggcttaattctctgagatgctccaggaatcagcgattaacattgattttcttttcttgttgttttttttttttttaaaaaaaaaccacactcatcaaaatctcttgtaaatcagaggaattgccatgctcaggataaacagttggtgggtggaaactggcttcaaatacgggtgtgttctccctttgaagccagtgcccagggccaggcttggtcaggatgggtcctgcaggtacccactggctcagccttcacaggtagcttcttcagcttacctcgtaggttgtcagatgggtcttctccctaggatctagcaactagacagtaaggactgatgcagcagggggtccacatgcctgtttcttccaccagagccagcatccatcagatcagatgattggttggagggtctctctgccatactgatgattaaatatgtttaatattgcctctactcttctatccctacagccgtgtttgtgagaagacagggctgttttcagttctacccaaagtggtgtcactactgaagtgccaacactataaacatttacttagaacctacaattttccaaagactattccctgtctgttggtgattttcgttaagaatactcttaacagcaattaaaaatactttttttctaagaagtcgatatcttgtctttgatacctagctatttgattagtgacagatacagtatttttaccaacatgttcctgctctatgactaatttttttattactgctgtctttattacaaattgtcttcagcttttagatctcacttaacatcttttctgttacatactttgtattttaaagcatattttctgaaccaattggcccaagctttaaaaacctgtaataaagtttgtgtcatgctttttccaaaagacagggaccactctctgttaaccctctcagcatttggcataatgtccttcttattttaagtgtgcagtacgtactttcacatttttttttttttttttttttttggtcaatgatagtattgaagaacttgaagaggagaatggactgtgttaaggagaagataagcaatttattgtttgtcttctaatatcttaactgcattttttttttttttttttttttttttttttttttggagttggagtctcactttgtcacccaggctggattgcagtggcatgatcttggctcactgcaacctgtctcccaggttcaagcagttatcttgcctcagcctcctgagtagctgggattccaggcacatgccaccacatccagcgaatttttgtatttttagtagagacggggtttcaccatgttggccaggctggtcttgaactcctgacctcaggtgatcgacccgcttcggcctcccaaagtgctgagattacaggggtgagccactgtatctggcctcaattgcgttttatgtttttcctcctgaaagagaaaataagatgatttaaaaattcacaatttgtcaatttgatctcacaagcaggaggtcatattctataaagtgaggcccatgatgtgtttctggtccagctgcagagacaaatggaaaccagcttcctctattcttagatgtgctgtcaagcaaggtggctgtgtgcttgtatcatttctccatcatttgccttctaatgatacacatgacagctgtgtataaaatgtactgagttgatgaccagttttccagcttctgggtgtcacttagtttgcttgttacatggatttgtgatcatcttctttgctaatggatgcaagaatccatcatgaagttctccttctcctattttttttaacctggggaaaaggccaacaaatattttagagaagtatttcagagtaagataaagagagtcatagcttttgttgcatctttaattctgaaataccattttccttttggctgttgtccaaatcctctttgatatccgtcatcctttattacgtgtcagaccttaagaaaaaattcctgtatagcacgaagtttcccagcctaaacatggtgatattgtgttgatgacagcggactgacacactgggatagcaacacacaggagcccttctcctaactctgccatcccaggtccatgaagaaacaacgtacagaagcgtcatgagtctggagtgagatgtgtttgtaagacttcagtttctgtaggtgtatcacaggacgccatttagattaagtttctttaaaactaaactgtggaaaaaaacctttgctcttcttatggttgagataattttcacttctagttgtagcttaagtgcctttagaatggctatttcagacattcttcctttctaaacgagtatagttttatccatttacttaccgaaagtttcaggttgattagctgctatgtagagaacatgctaagataataggacctggaaggctgcactgaagccttagtctctttatcagcttccttctgctatgccctccttccccagccagccctaaatcagtgctgcattgggtctactctgtgcaaaggtgctctgtattagaaatcagaaaccacactttttctttgcttccaaggattgtatatgtgactaggggaacaaaatacttgaagagtttatactcaaacggcggtgtagccagactagggtagggtatccaaagaagatctcctagaggtataccagagccaaattttgaaaatcaagaggtatgtgttgggagaagaaaagtaagatgaagctgcatgtctactgacaaggatgcggaagaagaggctgcgtctggtgtccaccgaagtcaggagtccagttaggcagtgagaggcggtaagcactgtaaggagggtggcggtgttgggggtggataaggagacacggagttttaatgcagaatggggtaggaactgataataggctgaatctgctcacagagtaggaggaatcaagaatgaattgcaggctgggcacagtggctcacgcctgtaatcccagcacttagggaggccgaggcgggcggatcacgaggtcaggagatcgagaccatcccggctaacacggtgaaaccccgtctctactaaaaaatacaaaaaattagccgggcgcggtggcgggcgcctgtagtcccagctactcgggaggctgaggcaggagaatgctgtgaacctgggaggcggagctggcagtgagccgaggtcgcgccagtgcactccagcgtgggtgacagagtgagactctgtctcaaaaaaaaaaaaaaaaaaaaaaaaagaaacgaattgcgcaatcttgttcgggaacctgggtgaaagctgaggcgttcgctcaaatggggacccggaattacgtttggggatggttaagcccgctgtgatgcctgtgcatacccaagcaggcatggtctgtagactgcgggacctgcaggtgtcgggggctagagatacacatgccagttctatacatttctcagcactgtgctgtcgattcacagcagttcaattgttcaagcgatataagccagtcatgtggcccaagttattctgtcggctgtgttctctgcaggaatctgatgcaagaaggcctgaaggatgcatggctttgaattcagccagacttcgcatcaccgttcttgctgctgcaccaacacacgggtgactaactgtccagtgtcttctgggaatctcctgacttcagcaccaagttctgtgcccaggagacccccaatcccagcagactggggcagttggttcccagtgggagtctgaattcttggggacagttgattgccagtgggagtgtaaattcatgttttggttacattaggtacagctaggaggttcagtgtgtgtgtgtgtgtgtgtgtgtgtgtctctgtgtgtgtctgtgtgggtgtgtctgtgtgttgggatggaggggggaacgggcttgtgccatatttgcctcaaattggtgacacatgtgtccaaggaattccgaatcattggctccctgtctatagccccaggagagcttatcaccattcatggtcctagcacaacatgcttgaaaatctaagttgtcccttaaattgtattcttcagaggactgtgggaaacagtctctgcaactccagaaacaaaagcttaaattgaaaaatcaacgctatttaactaaaataaaaaggctgttaccactgtgcccatcgttgcttctctactgaatttgtttcacagtcggccttcctatatcaccttctcattttgcctttagtttttttcacctgatattgaggactgggggatttttgttattaatccaataaactttattggatttgtgttattggatgatatgttgaaagatgaataacctgtgtctgtgtccgtgttgatttaaatgtaattgagagtatcaggatttagactttatttctggagaaaatatgcaatgttacgtttcactcaagaatttttcattgtgcacttcacataaaaactattatctttttcgttaccggttttctgatgtttaatattcttgataaaaatgattggaaaaagtgaattatttttataattgttgagttaatgaactaaaattaaagctgtagttagcaggtcatggtttgctcaaatatgagtgggtaatgcctgacaggattaatgccttatttgtcaagaatcaccgtgtaagaacatgaacctctgaaccccaagccctcgaggctacgcctttgtattgtacttgtcaccccagtggaatttgtttagagccattgctttcaaaaactgtagaaataattcacctaaatagttgttaagacaagtcatcctcctttgacaaggaggagctgaggcgttcagtttgggttgttggaatcagtctcaggcagtcaaactgataaaaagcagaaacgtgcactaagcgaagagaaggaagaggcatggaaactcccaagcacaatgaaagctggtgtttgtacagacctctggaagcatcacactgccctaaatttctaaagaaagcagaggagatcattctggcccctaatcttcctcttccacccctctggtgagaaggcaggctgcctaaagataatatttcattatatatatatcaaactatatgtatatcaaattatatatatttatatattatatataataatatacattaaattttacatctctgggcaggtatcattttagtgtggaagaaaaaagagaacacatgaggtttgaaagggaaagcataaatgagtgaattacgtaaacaaaactcactgtggtaagagcccatcctttaagatggcattgtggatcctgctcaaatactactgatggttctatctgtatcattcgatgccttgttgttgtaatttgttttaattttaaaaagctttgcctggaagaactgatatttcatggtcatcagtgaactcaattgactaaggaatgtatcctaacattaccttctagtagattccttcttgaatataacctctaaaatggtcttctttttaaggctttctttgtcttcactctatcgctcaccctttacctttccagagtcactgtctctggaatttttgtgataagaaaacttgtttaatatttctctatgggtaagctttaggagagtgggacttgatgagagtgataagcttttctgaccactttttcagtgtggaaaacactgatcatagcacatgttcaataattatcttccataaacacttgtgattgccttattattttgagtcagggtcttgctttgttgcccaggctggagtggtgcagtggttgattgatggagtcatgattggttggatcactgccgcctggacctcctgggctcaagccatcttccctccttagcctcccaagtagttgagactacaggcacatgcctcatcacacttggttatttttatattattttgatagagacagggtcttactgtgttgcccaggctagtctggatctcttgaactcaggagtaatcctcctgccttggcctcccaaagtgcttgactgacttattgaatgagcagtgcagaattcactaaattccattttttttttccccacgttggtcaacagaaagcttagctgtcaattcagtacccaaatataatacgttactgtagatcttagttgtatgggttcttttattggccctttcctctccatgatttaattttaatttttatattagcgcaatctggttggaagaatattaacaattgttcctctcacatccaccacccttactcacaagtgcagtatgtttatgcctctcgtaaatgaaagcaaaatgaaaatacaatacttgctttcaatttgtgaagagaccgctgttttgttgctattctgttaaatgtttgacatttattaaaactctgtgatgtgttatacattggatacagtgcaagacagtggatactgcatcaaagtaccaaatttttttttctttggagactgagtgtcactctgttaccaggctggagtgcagtggtgcgatctgggctgcaacctctgcctcccgggttcaagtgaatcccgtgcctcagcctcccaagtagctggcactacaggcccgcaccaccacacgcagataatttttgtcaattttgtattttcagtagagatgaggtttcaccctgttggccaagatggtctccatttcttgacctgctgatccgcctgcctcagccttccaaagtgctgggattacaggtgtgagccaccacacccggctactaaatatctttaaaaaaacaaagaaaaaatactctgagttgcagcaaacagtgcacagctttctcccatgttgtgtgctcctgaagatcagacactgtctctttgctttcatcttagtctccctcacatataggtactctgtaacttcaattgttgcccagttcggttttactctacgtatatcaaccattttggggttgtaatttggaaaacaatggacaaagaagtgctggtgtacaggataaattgagcagaagtgagacaggacgaggaagtccttggtccgggagaaaagtggaacccagtcatcaaggacaggacacccaggccatagcaggagagatggctaggacagggccagtgaaaggcagaatgtggaaaaacaagaaaaagagcaaaattgagcatcttctgtgtattgggcatggtgcccaggttttatacatatgttatggaggttgagattgctaagtaaagaaactgggtgaggatgaagtcatttactgagatagggaacgtaggaggggaagcttgcagggctctgttatgtaaaaatgcccaaacatagctgctcccaactgcttgccaccattgtttctctttctacacccgaccctattctggcatttcttccccatactccctctctctccctctcttcccatcccattcctctcaggctgattatgttcatgatctatgtggattgctccaagatgtattctggctacagcagtgaatattgattatctctattatgggaatggctaaataattagatgagtccattgggatccaacttcctgtgactcacagacacagcctaaagacaaaaaatgacaagtaacttcatattacactgaaggatgatggttttaataactgaattatcaacaaaaattggggaaaaatatgaacttctacacggctattctaaacatagccacagtatctcttatgttatacaccagaatcattctggaaaaaaagagagggggaggcttaaaaccaatgaagacagatgctcatttgagtcttttcatctgctcctggtaaaacatttctgagtttcctttcaatagttacaacctgagtgtgaataagcatagacagtgtaattattctgagaaaatagaagtaaaactgtattgtagaagaatgtacttgcttttgagtgatctatattgctaaatatttgcaaagtctggttagacttcattagcttgttttatttttgcaaatctcttaagctattcaatctccttagaaagaggtttatagcatccttctgtgggccttttactcaagaaccataaattaggctgaacgcacacaagtaataaataatactgactactatccatttgtaccttaggatccagaagagaaacaggtacactggtaatttatctggaaattttgaacttaatagatgaaatatgtgtgcatgtgtgtgtttacttggtgaataagagaattggatacacatcagaaagaagatagagaaattaccttttaccctgtcccagaattaggtttctgtctccttctgcagatgacatcatttaaagccttaaatatggttgtcattatgtcattcagaaaaattcaaaagtgaaattaagatgaaatgggcaatgccaaaaaagatatatgacctttcctactgagaagaaagtcagatgttgacatatgttggtgaataaattatattttcccaccattacatttattaattgatactaagactttaaaattgcacaatacaggaaggaaaaatgttagatttcaaaggatgttcccatgatttatgtaaacttatgtactaatctgaacttaaaatgactgagcttcctttctgctgttgtctgggaaagtatttaagggaaaatagctccacagtgaaaatgtcttccaatctgcatcagggcacacagggttactgaaagtaggagttggacaactggcgtgttttattccctgttaattgagttagtgcagaaggctttttaaattaaaaatcctcctagatcggcaaacaaaatgtacccttttttgtgttataactatatttggaaatgctttgctaaatgggcttttgattccttcacctgaataaagatgaaaaatattttcagtgttaaaaaacttttaaaaatagacattatggttacatgttcaccttgaggtgatacgagcgatacacattggtaaaagtgagaactaggaagagatcaagaacatagagaagggaacagaatttccactggacagctaagcttaggggtgatattccaggaaacctcatgcggaaccactttagttttttagttttaccacctgcccctggcaaaaatttccaagaggctttttggtactattagcattgtcttttaaaaaatatggtgagtgtggtaattgtcgtcatttccgaaagatgagtaatcgaacaataaaattgtacattcgtcgagcctcctctacttacacttttttaagtttatcacttaaatctttgaaacgttgtgacttcttagttgtgttcgtttattttcttctccttttataacacttgatacataactgcaaaagagtcttaaatcttaatttggagacttaattttggttttattaactatgagtgcactttctaaaacaagaggtcacaggagagtgtggaaaccattccttccttttccgtaaacctgtcgactttgaacaagcttagtcaagtgggaagtattacatgaaagcgttttctgttgacagagcattggtatttgtagtgttactctgttatctgtagagtgagggatttggattagagcctctccaaagaacattcacatcttagatttaaagattttgtttactgtctatgaataatataaattctactccttcctctgggtccagacaaatgccatccacttcaggcttcctttcccaatcattcaaggagctgaaagggatttctatttcctcttaacttgtatagcattttgaatgaccacattctgataattcattgtaataataatgatcacggtctgcctcagactttgatttgctttagttgtatctaacctgctataacgtaagcatccatcaggcaagaactttgtcatgtatatttgttttcccttatccataataattgggaaataacatgggatcaataatttattaaaatgttgtttgtctttaacattctatttgcaaatgtacatttaagtaagtaccttttcccaaagagacgctgtcataactgaggctaggctcgcagacctgacacaggctgatgatcctttttgttaactccacaatcccttccatgcaacagtttcttaccactccacccagtcatctcctgctgtttttgtagggccaatgttttttttttttttaaataaacacggtctctgccaggcgcaatggctcacgcctgtaatcccagaacattgggaggccaaggcgggtggatcacaaggtcaggagttcaagaccagtctggccaagatggagaaaacttggctctactaaaaatacacacacacacacacacacacacacacacacacacacacagacacacacacacacacacacagacacacacacacacaactcaggcatggtggtgggcacgagtaatcgcagctactcaggagactgagacagagaatggctcaaatctaggaggcagagtttgcagtgagctgagatcgcgctgctgcactgcagcctgggtgacagaatgagactccatcttccccacaacaaaacaaaacaaagcagaaccggggtctcattctgctgcccaggctggagtgcagtggcctgatcacagatccctgcagcctcagtctcccaagttcggtgatcgtcccacctcagccacctgagtagcggggactacaggtgtgcaccaccacccatggctacttttgtttgtttttatggagttggggttctgccatgttgcccaggctggtttcaaactcctgggctcaagcgatccacccatgctgggctcccaaagaagcaggattacgggcatgagccaccactcccagctgggtccactcttcaagtgatcttctgtcccaaaggtatcctagaaatagatgattgtggaaaaaacaaaatgtcttttgtttctttgatgcgtcatttatgaagtatgggtttcagttcaaaactcacgtatgtaacgaatgtaacaacaaaatcacaacttgctgtctacagtgaacacggagcccttccgcctatgaaacagcctcgtctcctcttcttgggctgtgtcaagttcctaagagttggcacagagtcagggtgctgccagggaagaggcactgacattgttgctatcctttcgtctacctcaacaccgaaatactttttctctgaccagctgaaaggcccaggtcacgtccctgcatccgtgctctctcctcttgtgcccttctccagcgggagaacacttctgcattgaagatgttaattactaagtaggcaatttaaacattctcgttaatcatctatttctgacacatttctgtgatttcttagtgtagattctcaggaccgtctattattggatacttaatgcaacgttacgcccccaaatagaaattccttccaagttgtgggaaagtgacaatgtaatgttctctagtggcttcaataaccttactttcctaggaacacatgcctggcccagttcgactctgaacacacagttctttcttaaacaccagcgtattatttcaattcattgaagccatttttatcacacaagctacccaaatgaaaacaaaaccaatgaagtataaaattggctttatgaaagcaaagactttgactttcttaagtgactcactggagggtataaattttgaaagacgatttggtacagtaagaaatagtattagaataatccaaaagcatagaatttgttgagctcctcaaatgagatattaaggaaaagacttcatacacttctgaagtatacagaaaatggttgatttaatgaggcagatataactaacggaatgtcataggtaatgacagagaacatatggctagaaagagaacaagagaaaaataatggtcaaacaatgaagaaagtagtcttaaccaggattctgcacattaaaaaaaaggtgtcagattcttctagtgccatcacccaatcttaaaacagcactgtatctactatccagtcatactttttttgttgttcagagaagtaacatgttaaacatgtagttttgtatgagtgcataaatgtgcagtgatttcaatatgggtataggttttcattttaacacctgaaaatcaaatgcaagagaagggaaataacatttctttaacacagtggagatttcccagttattttatgtaaatgaagaagggagcaaatatgtaagacctggacaaggtcagagtctgaacaatcaattaccttggctgcagcaggagtcctctgggttgtcatttgcacctgaaggcttgtggctgaggtcacaagcatctgattatctggaataatatgttcttagtcaaatcagggaaaattaggtagacatattcatatcattttacctcattattttccttcatgcacctgtgcttagagtgaccctgctttttgatgttttcaacatgtcatcacaattacaatcatgccctgaatgataataaccatgtttacagatggcatctatcccttgtgcagaatgctcagcatttcatgttctggagctgctttaattcttagaaaacccctaaaagatggacattattgttctccgtggctaaaaaaacttgtctgtcaaaatatatcctaattgaatgcgactgcttatgtcttcctcaggtggttttctcacatgctgttgatctaaaagttgtccatttttgagcaccacattcagcatgacctactccaagaacctctgcttttttttttttttttttttttttttttttgagatggagtctcactctgtagcccaggcttgagtgaagtcgcgagatctcagttcactgcaacgtccacctcccagcccaggttcaagcaattctcctgcctcagcctcccgagtagttgggatcacaggtctgtgccaccatgcctggctagtttttatatttttagtaggcacagggttttgccatgttggccagagtggtctcaaatttctgacctgaagtgatcgacctgcctcgacctcccaaagtgctggggttacaggcatgagctactgtgccaggccacctctatcttactcttctcaaagatagtgtgtgttttccttccttaacatgtcaccattcttactccgtttgtacattttcacctcatatcacaggtaattatatcacacacgaatatatgcatgtatatgtacgcatttcttatgaggactcctgtagatgtgatgaaatgaaaacatagctgagtgttttcacatgtcaactttgttacccagaagttcgttactaacactgtgatcaccatataagggattttctggacatgacacagatcacacttggtagagatagaatgtgtttatagtttgataaaactgttcatattttggatcatctttagccaactgctgctagaattttgttgggaattgcaggattgaatggtataaatgctatttctttaactgcacgtcaacggcatggctgttccagtacattctttgaatgcgaagttttctttatattttaagcaaatgcatattattcatgtgtcttgagccacacgtggctgacatatcattcgtgaaattctatactgtattctggtgttaatatatgtggcatataaagaaacacataagatgaaaagataaatcttgattgcatcatacaattcagtgttgttgaataatgaataaagattgttgcaattttcttggaactgtgttttgttgcctttgttatcaaagccgttgtttcaaagaccagtgtgtatgcatattgtgggtagactttctctaaaataagttaagtttattttctagcgaatacaaaacttaggcgaagattgattgatgctgatgatttgacattatccatcttaaaacacattaattacaaataaaaattgaacacctcttgtatactcagtaatatatcactgtaagaattctaccatttaaaaggaggaataagatactgttgctataccagctaccactttttacagcccttttatattcagaaagtaaaggcagataccacctctgactcttctcaaataattgtatattcacaattacaatcgaaatctttaaagtagacagtgtttttgggagatggaagagttaaagcaatgacactattttggagatacctgtggtgctgtagatacattacgttgagggacaaatatcatttatgtttatataaacataaacatctgttcactgtaaacaagcaatctcattaatttacagtcccatctcaaatcatgtaaataaaggcaacttacatatttcagttttagaaatcaaattttaaaaattgtaagttatcacagaccattactgtctttggattatatgcaaacataaaatagtgactgattgtattatcaacaaatacacatttcggggaactaccttttcggagacattgaataagggaaagtcaatgaagttttaaaagtactctggaatccccagcaatccagagggcttgcttctgtttttctagccaatttggggaagagctataagtgaaacaagataaaatctctttagttgcatatggtttgagaggttcttcaggtaaacagacataaggaataacatcttttatatacataacagatgtaatatgcttgtagataagcatgtaagtagatgtatttatagaactgggctttatatgttcatatatacagtggggactggaaacgtaggctttgttaatggtagaaatctctaggcaaacgtgtgggaatgggatagtttggaaggagaacttctactttatactttgtgttcatttcttttctaacttttaataatttttttactgttataaaaacaaaattttaaagattaataaacagccatcactgcactgtgtatgacatcatgtctgctataaagatttgtcaggagattgtcactttgcctgcatttgaagctgtgtttcagatgtttttgctgaatcaggacaggagataagagtgggaggagataagcatttcgtcacgtgtttctacaactcaaactctgagcagttttgaaacaaaatgggtttccagacctcttagaaaaaagcggggggacatagaaatgactcagggcaagtctaccttttattatttggttttcggaacatttggcccctgagtttctcagtacaatggttatgtaagaagctgataagatttataaaggaatttcctaaaattgtagcagcatactttaaaataactcaaatctttctggaattttcgttcatgcttttattactcaaacttcagtgtttgattgaaccttatttgatttatcttgtgatacacccaagattagtcagtcaaatggactgcaatgcaatatttaagtaaaaattttcatttatctcctgtacctcaaacgttttaattggtatttgaaagatacctgtaaatattttagaaaaaaatgtgacttttctgtgaaataaaattaaatacctaggtggtgaagaacttcagcattatcaaatgtattgaacataaaatgtttgcatagatgagataggctttcatgtgcttctatgttttgcacatgaaaattgaaagttatttataatgcattctctctctgtaaaataccttatgtctaactcctaataaaacattcaacactgatttcattttaagaaagtaatcttaaagatgacttctggggctgggtgagttggctcatgcctgtgattacagcactttaggaggctcagacaggaggattgcttggggccagctgtttaaaactagcctagggggcagagtgagacctccctctctactccccccaccaaaaaaaaaaaaaaaaaaaaaactgagtgtagtgctcaggcctgtagttccagctactcaagaggctgacgtgcgaggattgcttgatcccaggagtttgagactgcagtgaaccaaggttgtaccactgcactctagcttaggtgacagagaccctatctcttaaaaaaaaaaaaaaaaaaaaaaaccttttgattaacgagtcaaattattaggaaaaaagtttatattttaaaatgataatagatgtatatattttcattaatatttttaattttttttttttgagatagagtctcactgtgtcatctaggctgaagtgcagtggcatgatctcggctcgctgcaacctccgcctcccgggttcaagtgattctcatgcctcagtctcccaagtagctgggactataggcattcacccccactcccagctaagtttttgtattttcagtagagaggaggtttgagcatgttagccaggctggtcccgaactgctgacctcaggtgatctgctcgcactggcctcccaaaatgctgggattataggcatgaaccaccacacccggccagaattaattaatttgtaaaataatacattgatgtgataaaattctcaagcagcacaaatgtatgcaatcaatttttcttccctatcattgcatggtactacctatctttccagagaaaatgctaaagttggttttgcatctttgaaaattacatatagatatgcatgtcagcaatgttatctgtacatgtctttatatccatagaaattatagagggaaatgagaacagttgctgagatttttttttgtgagtaacaagatgaacaatgattttgtgctgggggaaaagggataattagatataggtgtgagtgagagcaatcctctgactccttattcattgtataattgcataaatatgtaatgatttatttacatgcttcccagttaatagactttccagctgattccatttttctggttatagtaccaatgctgtgagcatcttataaatatatacaatatgtataggtgcacatgcacatataggtagggcatatttcaaaaggttgctggatcaaaagatttctacattattaatctagaaagaaacgtccaaattagcaagaaatttacaccaaagctgcactttaaagagaatgagttcctcttttccaatatcctaacacagttaaaaacagtgttttaaactgttgatcactgctattttagatatattaagcttcttaactcttaggaaaattaagtgtataccccccatgtctaggctggtgaagtgtgcaggccaggatcttaattcatgtgtggaaactgtaaacatatattattactccttattaagcttgttaactgttgtgtagttgattctcttttgggatctcattacaccatcctatctttcgaagctgccttctgtattagtgcctttaattttcacccctgaatttacatctcttctcaaagtcactatttgtaggcttaggattctccattagtaacacaaaactgatttatgttctctatttacttatttcaaaacctaactaaatttaaaccctgcctttaataagcacacattttcatagtacgcactcctaccaacttccattttgccttatggtgctgttttactttaccttaaaacaaatatgtaagtatgttaataataaagaaatatgtattttcagcagatagtaaactcatacttcaaatatacattttcaaatgtatgcatatatgtatatagctatctcagcttgttcgtcaaacggaagaaagtaggaaaacataagaatgttaggaaaaagttagatgaaaatcattacattattaaatattaagtaataaacgtacgtgaaataagttagtaacccacaaagttgtatagtaatatctcacaatttctttaattttgaataattatatttaacgtattgattaccaaggtaattttggcagcagtgaaaggtcattttcaatttagtagttgtttaatttgtttaatagaagcaatatatttcatataaagtatttcaaataaatgaaatttgcaatgtgtttaataaaatggctcatttacttaattgaaataatctttaccacagcagtaacaaggtgatatagatgattaattgatttgattgattagtgtgaaccatataatacagatgaaataggatggcgccaataagacctatatcagctaagattactaaaaagaatatagtttattattcagttctgaaatgaaaatttgccccaaacgtctaggactgatgaagcgctcatgacttcacattaattcatttacggaatcctacaccatatattgttacttatgcatacttaaactccgttggtctttggtaatctaatgctttcaagggaacgtgatacagattcagataatacacctttcaattttgagaattagatcttgaataataagcaaatcttttgatccttcaagcacttgtgattcagggcacatggtttggactcatttgtaaccaaatatttgcaggtaactgcaggtaatctcaactgagtatgaaggccgcaagagtttgcataagtggctctacctgcaggaattccaagtaaatactactccatgggataatgtaggtataaaataataggagcatgattcagcacaatgtgactgtgcagggctccccacactcccgtcagcttagagatggaaagtaaaacatgtgaaaggagtgggacttccacctgcatcttcctacagccaggtgctgtggaacccaagcgttggtccattgccacatgtcccagttaacattcagcgtcatgtggatgggtagagtttaagtatccaccaacttcaactgtatttataattaagctgcatgctccagtgagaaaggggtgatgcaggacagagttcagagactggagatttggtgctgcttcagacaccacctccatgagcattcaggaaagccccaggtctcttcaaccttaaagaactgcactctaaaaacaagacggcttgggttgagattatttcaggagtttcttgcagatcgatctcaatgtttatgagttttttaagaagtcagcaatatctaaatcaggaagcacactcaattcttttctgagtgcagcgtagtgtgctagaaacagcaggaacttggaaaccaaagaagctgagtgtgaatattggctgttccttcatagctaagaggcttggaagtattccatgcccccttttaaatgcagatcagaccactttattgggtttctgtcaacatttatgagaaaatacatggaaaacacttagagaattactttaagcaggttgatgtccaagcctgagagccggcttctcaggtgagaccacttgaattctacaccagtgaggcaggtgaactaggggcagacctgcacagttttacagacaagcccatcaaccaaacacggcctatgaagttcccatagagacaactcaaagatctctgtcttcacaccacaaacatggaactcattggcagcctaagcaagtatataagatagtagaatcttattctatgctaaaggtcttataaatattaggttaaactctacgaactcctttgtgtgactctgggatctggaaaggcttggtgaacagaggctgatagagtatgaaataaaaacattttaaacctgatagtctgctcaagatatctgcagaaactgtaatataaatatgaaataaatgacaaaaatacatacgcggctatgttataaaaatcttgagaggaaacttttcatgtaattaacttttggtgaatgtttctgattttacggataatcatgactagaaaatgtggctcactttgctagtcatgattacagtaagttgttcacatacaaggatgttagcaataccttaaaatgtattttctttttaaaacaagcttattttttttctctcaaactaaataatcatatttcagttacttaaaaggaagtttacttttctctactgcctaatttcagaaccagttcttcaatttgatacattggtcagtcattgatttgatttgttgagacaacaaagttttgctttgttttgttggattggatttgccatttctaaaattcccctaaaagaattcttttgggtagcaactgtaggattcattttttcggaaatttgttcttccatagcctgtcccattaaattaccttgaggaaaaagcactgagtctcaatctcagggatagagagaatcaggatagtcctagaaagctgagcaagaaattcaaattgcagcactgtacactctaggtaagatttggaagcaacctcagtgtccatcaacagatgaatggataaagaaaatgtggttcttaaacacaatggagtactcttcagccacaaaaaggatgagattcactcatttgcaccaacatggctagagctggagatcattgttaaatgaaataaggtaggcactgaaagagaaatatcacatgatcacttatttgtgggatctaaaaatcaaaacaattaaactcatggacatagggagtaggatggttaccagaagctgtgtagggtagtaggagtgaaggaaggaggtggtgattgttaatggattaaaaaaaatagaagaaggaataagacctatttgcttgcacagcaggatggatataatcaacagtaactgtcaattttaaaataacttacagtgtgatcggattgtttgttacttgaaggataaatgtttgagaggagagatacccctcaacctgaggtgattattatgcattgcatttctgaatcaaaacatgccatgtaccccacaaatacacacatctactctgtacacacaaaaattgaaacagacttaagcacgtttgatgtataaatcaggcaattaatctccacaagaaggagagattgacagtatccttttatagtgacaaaaacagataagatgaaaaaaacaccacaatacaaggtgggtattaaaatatttttatttaagtatgaactaattttgtcctacaataagttaatatgaggcataagaagcctaaagccagtgtctgtaagatgagacactgaaatctaactctctcaatatctatgacttctattttttatgctgaaatgaagaatatatttagctcagttggacatgttggttttattcttgaaacttggaattataagatctgtgaatgatcttgattgggtcttatattttaacaagctgctgcgtatgaagttaattcaatatgtttgtgacagaaaagtagatggtgatgtgtggatgtaaaggctaagaatgtagattttggttaaaattctaattattttccgtcaaatctacatttgacacacactccactctcagggtcacacagtcctaatacttggaaggtgagctttggagtcacacaccctgccctgaaggtgttcgggacacggtctgtcttctattgtcttgtttagctgtcaaaggtatggtactttttattgtagccacatggccaagacagatctcaaggcagccacagccccacacagaggcacctccacttgtcagtaacaactcgggtgacctcacaggaaatccccttcccccagggaggtggtaggctagcttccaccattcactcatgtgccgtgaagagcagattccatgattcctggaagggagcatgacagccataggaaaatgttttgagtgttgaaggaggcaggcagttaaggtttcagttttcctggacaaatcatatcataacagggcttccaaagattttctgtggaaaccagtgataagtttaacaaaactagacaaactctgggcctgcatggtgacttctttggagtgatatcacactgcaggaactctgagttttctcctaataattaaataaggcctcaaaactccataatcctgcattttacctgtgtcacatttggctgtggaacaatcatttgtgaacagtaggtggattaacaaagtacttataaaacatacatttttttcaaggtttaattttccaaagatcagattggctgatgtacttgtgtatcaatttatattccctattgaaattgttatatttataaaaataatatattactgatactttaaaatacagtttttccttatttttagcatctactgttaatggcttccatttttattacaccgatatattacacacaaactatattagacattcaacagtattggcttcttaaatgtctccaagagtagacaaaagtatgcaaaatatgagttagattacatcattttttctataggaaataattggttttaacatctgttgtcactttgtcatgcagagtcatgtgctgacaaaatacagcattttcttgaggaaaaagatgtagtttgttcttgcggttgcccaggagacagctatggatggttgagccctggtgaagtagggcttcatgggcggtgcagggtctggagtgtggaaagggtgtgtatttgacagtctaagagctaagtcccaaaatcaccggatgagcactgtcaggggcatgaaaacatttgttactctttgttcctttccagtcaaaaagtaaatcgggtttgtgatatgtcttcccagttgttactctgtctttaattgggtggaaattttggattagcttcattgactgtaacatgaacttcctcctcctctattgtgttttagtcaatgttgggctgctcttaagtgcttcatcagacaattttgctgggttttctttttgttgtttctttccttctgttagagtgtggggacttcataggatgggtcacaaagccaagggctgagttcaaaaagtggcttgtgctgccaaacactcagatttagtgttcttagatccagttagttagttagagacagtctcatgctgttgcccaggctggagtgtaatggtgcaatctcagctcactgcaacctccatctccaaggttcaagcaattctcttgcctcagcctcctgagtagcttttacagccacaccctatggaattagctgggattacaggtgctcattaccatgcctggataatttctgtatttttagtagagactggttttcaccatgttggccaagctgttctcaaactcctgacctgaagtgatctgcccacttcaacctcccaaagtgctgggatcacaggcgtgagtcccaatgtccagcccctagatccagatatttaaaattccttgtcatatctttgaaaagaattgaagctgttaatcttgaggctgaagagaaaatcacttcctggagcccacagtgaataaacctcaattctacaagtttcccccttttttgctgtgttcttatcctgacttttgtaggattgtcaaagaaatggggctgtgcctgtgtgctttagattccagtcttttttccctttttttccagattcattaaaagtatcttgcaaaggacagaggtaaatagacacaaattttaaactccatctataaattcataaaggtgtaggaaataaatgttatttttcaatcaaaagatgggaattttatatattcacatgccaggtgaatgactgcaagtgggagagtgtagctctttcagacaagggcagatttgagcataaagaaaactggctttatcaaatttgtcgtttcccattttaagggcgcttttcatctctctgttgcagcacatgtctgcttccacaaggtttttcttgccggcagggggatctggggctgccttgggaatgagggaaacacttggccgcgcttgcagatagccagtgcgttgacctcgcagggaattgcctttaatgtgccctattcctggttcaaaggttgattcttttagtagaaatttatgtaatgatgtcatgtccatgatattatgagttgtatataatagcagtccccaacctttctggtgccagggaccagtttcgtggaagccagtttttctacggaccagggtgtgggaggaaatggtttcggggtcattcaaatgtagtacatttataatgcactttatttgtaatattattatattgtaatacacaacgaaatagttatacaactcgccataatgcagaatcagtgggagctctgagcttgtttttctgcaactggtcagtcccatctggaggtgatgggagacaatgacagatcatcaggcattggatagttataaagagtgtgcaacctcgatccctcatatacgtagttcacgacagtgttgacgctcctgtgggaatgtaatgctcccactgatctgacaggagggtggagctcagctggtaacgtgagccatggggagcagctgtgaaaacaacacagcctctctggcttctgctgctcaccccttgatgggcagccacattcgtggctcgcggttggagacccttggtatacaacagagtgctaaagaaatctaaattgttggttggtttctaatcaataaccaaaattactgcttggcttcatatatttttatttcctctatggccctggtttgaaatctcctgtgaactttcaggagttaaaagcacaggctctggagagagacgccagggtttgaatcttgtctctcctgctctccacctgcatggtcttaagtcagttattaaggatctctgaggcttcgtttcctcacctgcaaaaggagtgagctttactgcctgtctttaagtcataagggtgttttatggatgttgtgagaatacagtgttttcacactccgagcatttaccagcagttagtagacaccccaaggagggtaattgatacttgagtttttgtgtcattagtccatttcttttcaccaggctccaaatctaggaaatcaacataacatgaaacctgccttagtgtaggttaatcactaagttcatagccagggaaggggattctacaagcagtcctttgagtaagttacttaagctgcctagtctctgggctcttgcctcataaaaacctacacctggaaaacagttaagttcctgtgtgagtttactgttttctcataacccatttgacaaaatttttaaattccaattttactttttcaaacttcgcaatataattgccaatcatgtttttataatccatgcatgctttagcaaggatttattttatataatcacctttttgaactcaatagccaatatttctgtattctaatcctgtctgttttagtctgtgagcactaccaaatctccttacacatttttgcaggccttttgagaatacattgacaaatataatgaagtgcataaatgtaagttactgccgtggcttttaaaacaatactgtgtttatttgaagtaattcccatttacccaattgttacatatcattcacatattttaatagtatatataataaattttattccaccaagaaaataggcccacatttcgtagtactttatcttggatgtgtatgttaccaacttattaagcatttgctacatttctaatacatgccaggttactgaagtttggtttcaaaattgttagaacaacaattgattccattgtcttaattctgctgtcaggatttaggattcttttgtttcattcctctatcttttcttcctttccagttagcctctgttttttgtttgtctgtttttcgttttggttttggtttttgccacaaagaggtagcctcagagcaaagttttgaaatggggccggggctggtgtagattatcagggtcgggtgttataaagtgtaactgagtagcaattggtctctacttggtctctctactttcttctctctctgccctcctctcctgactgtgtgctcactcgctctcctctcaccttgttcctccttcaatctaagtttgtgcgtatggttctaagtgcaatgaattcctcccaactattggtttcaattttatagacgttaggttcacccttaagaaaatcacgaagtaaaaatacagtttgtgagatatgataaaataaatttgcatattattatttaacatctttgagccatttcactatttttttaatgttgttgagataatgaaaacagacctggaataaactctaggggtcactacctactcccctcccttgcctttgagcaaatcatttagagcctcacctctttttctacagtcatgtggtctgtttaagattaaatatattaacactaatgatcatagaagaaaataaaatggacactccacgagttattctgaagaagcacaggtcttatgcgaagtctttccagagaaaagtggcataactgaggggagaaaagattgaaaggacatcttgatataaaaattctagtagtgaattttacactgttaagataatttatggatccttaccattcaggagaagctggtgctgatcacacagaaggcaaagagtggaggggacaacactggagtgaagtatttgcagtgacaattgacaggaaaaacgctgttactgttttaatgtcatttgtaaatggtttgattgtcataaacatacattatgtggatgctgtttcatgcttgggggcaaaatctctttagattttttgtttccgatagtctattacagacactgtaattataacttgcccaaaataacttggtgcattgattaaaaaaaagaggatcagttgaattcttgacaaacttgtctagaatgcaatttggggaaaatttattttcttccccagagtaacttttattagagagtagtgtctatcagagtgtaatttcttaggaggaaatttttgtttagtgcaaattatgatataccatgtctattaaatcaccataaccaaatgaaattcctctcagggtcccgggagaaggtagactatgtcataaccatgaggtaaacaatgatatatttgaataaactgataagcctttaatgatgtaagccttttaggaaggaaaactatcagttaaagcaatatgcagtggtttaactgcaatattttttcagcaccaaaacataagatgtgattttagaaaatttcttctccgacccagtattcatggcatgagaaagctggggcctaactcctgagataaaggggcaccttgcttaggaaagcacacgtaggatagattctgacatagatttgctttgtggaatcagcacatttagctttatttataaacctcacttctgggatttaaacattaagttttgtttctgcttttatacttcctggttgattctgaaaactcaggcagtcgatttcatttcagtgggaaggcacttaaggagacctcatcttccagctcagcttccagtggattctcccctttgcctcttgtctttttcattccctgatgggtgaccactgattgaatccccaagtcttggccaaaaatggaggagaggattccctcatttcatagaacttaactgaatgggcgtggatttcttcccgagccaatgagatcctgggtatgatgggaggggattgccggtatatttcaacaaatacgggtggagcacttctagaatctcagcatacggctgtgggttacaggagacccacttctgccctcatggagctcctgttcttttggggtattggggtccatctcttggggtacccagcatgaagggccctcctctgtgcattcgtttctctctctggaatagtctctaaactttgactttctttgcctcctaaatcagtatggaccaaatccttctgtaatgagtctcacgcttttgcaattttctgatccaacttgaattctacaaattatataagctaatctgtttcccaattgacaggaggagttgccaaagaaccaaactgagccactgttcacaaaacattgtgtgaaaggaggatgctttttctttgtccgatatagtttgtatatgtagatgtgtgtgtgtaaaatgtgtgtatatctatgtatacacacatatacacatgtaaagctcttgaagagcagtgaagcaaaattgatgagaaattattctcttcaacaagaagtgataggactgttgaaatctcatgatgtttttaaaacataaccagatattcgtgtaaggcaggcatgatccttttagaattctatccaattatataaatatatattatatataataatccaattatatatcagttttcatagaaaaaaactgattaccagtagtaatcattttatgatggacatatatactgagacattgtattgtacactgtaagtatgtaaaactcttattaaaaaaatacctaagataaggccgacgtgcagtgccttatgcctatattcccagcactttgggaggatgaggcaggtggatcacttcaagtcaggaatctgagaccagcctggccaaatggtgaaaccctgtctctgttaaaaatgcaaaaattagctggacgtggtggtgcctgtaatcccagatactcaggaggctgaggcaggagaatccttcaacctgggaggtggaggttgcagtgagccaagatcacgccactgcactccagcctgggcgacaaagctagactccttctcaataaataaataaataatacacaaaataaccaaatttaaaatgaaccctggattattaatatgacattatcagctattttaataagccctaaaagttctgtagtttccgtgtttcctaaaggaacttgagcacatctagtattactgaaagtgtcataaggtaagttgcaagtttattgtaggaaaatacatgttaacatacttctgtgtgtatacctgctctgacatgtagagagagatacacatatgccaggcatgcagcctttttactccagaaattaatgtgaaaaaccatttccatattgcattagcaaatcatttaggtattcctattgaactacagcttacaaggaagataacaagctacctagaattacttttaatccctagtaggtactagatgatagagaaaggtgttgggactcgttagatgtgaagtagttgtcttggtacaagctgtcctgattttccttgtatcaagttgatagtctcctagttgtcttgtgtttagaatgtgtggttcagtggacacagtacaagtgaacatgggtttgttttccttttaagtgaagccagattcacatagatgtggtgggtgctttggagaggaggaaaacaggcatcagagatgtatcccattcactcttgatattgtctgatatgaaaacgagacatgtaaccttcatgtcttaacaatagcaatgaaaggcttcaagtacagtagctacttggaatatctttactactgggccaatgaggtgtcacagcaaggagtcagaaaaacatttgaaaacataactttaaataaagtgccttaaataaagggcagtctgtgccctagagacattatattaagtagtgatccctgactttaaaattcaacagggttttaagaaaaagaattattcaataggttaaacatgcatatatttgtatgggttatacattgtgataaaaatctgtaattgaagtttctattgagagatttatatactttatattaatagtttcaaattagtgatatgctgaatagaacagaaaaatacataaatgtaataggtactattttctgaggccaaaagttaacgtataaaaataatgtaattattacatggaatttacaataatttttacttcgagtctctctccaaatgatggcggacattttaatctggtaagatgtatatatactcacatgattcactgtgtgtgtttgagtgtgcatgtgtgtgtgtgtgtgtgtgtgtgtatttgattaagtctcttctgaactttgcctgcttgattgcatcttccccggatggtatctaagtccaagagagttctatgaccccaaggtacctaggggttgataaagcacctggttccagatcaccctctgccgtgtcctgacacagtttgacatgtaactcactgcatccagtattttgtcaacagtaccaagacctgctcaccaaggccacataactcaagtgatctcttggactgaggaccattcagggcacggcgtgtgcctctcttgggctcaggaatcgttagatggtccctgcacacccatctggacttacccattgtgtagattctgtcctcaccacccctacctggcaggagaggctttctataaggatggtgacctcccaggagccacagccacctgtgctctttgatctcccaagctctctggggctgttccgtctacaccagttctcgtggggacatgatcactgatcacttcttgatatctaaattgtccccatccctagaccaggccagtcttatccagtgaccgaatacttctaccataatttctcttctatataaaataaaaagctgaaacacctgacatctgatactaataccccttcccacttttgaattctgctataatatagtacataatatagtatactatgtatcatgtaatattacatactatatttctatattatataatatcatctgtattgtaatataaaatattactatattactatattgtataataaatgtatatagtaataaaatattactgcattatataataaaaatattactatattatataataaaatattactataaaatatgaataacaaaatattactatattatatagtaaacaatataatttatagtatatatactatactgcacatactgtgtatatatactatactatagtaaatatcctatatattatacagtataaaatactacagtctttataaaatatataaaaactttactatatatgtcatatatataaactgtagtctgtatgtttactatatatgctctatatagtatatgtttatgatattgtatatatagtatataaaaaggtttactatatatactacatacaaaatatataaaaaggattttcaaaattatatgctatatactacataattaaaaaaactttttatatctacaacaaattttggatgaattctagaacagaaattggaataacttataaaaaataagttattttactggaaaacttgtccggtaactatagataaaaggcttcttaattcacagattccagtctatttcctgattacctagcctctgtatatgctgtctggaaattaatgtcagtctctctgtcacatccataggcgataagatttttttttttttcaaaataattccttttatttatggccagttttcttcagtaaaatttcataatcccttggagatttggaaaacacattttaaaatgtttaatgtatacctctttaattttgggctatgtctacctctctaaaatgaagatactttagcatgcttgtattttttgtaaaacactaaaaaattacgatagggagtaacatatgtcatattttgttgaaatattcaaagtttatcagtaacgttgcatatactaaaatattcccgtactaccctggaccatcaaatatgaatgacagaaggaagacttgctactgcaagacacctgtgtggattattgggatttacttcaaaatccattttacttcaaaatgtttcgtaatttactatgtgttgaaaataagccagttgcttataagaagcagggattcctcaaagtgaggcagacaagaataaaatgtatcgcaagggccctcatggaaaggatactcacagaagtactttcatgtcttcaggagcacatttgtgagccaccaaggagtgagtcttgccagctccttataagattccttactcgcagccagtgtggagtaaatggctataaacatttaatcacaaatttagctcttgaaagctctttatgatcaattggatccactcatccttccgcatccctgtcaactaatgttggactctattttttttttttttttttggcacacaaataagaatgaatccatttcattgcagctatttgaaatcagatcacatgcatatattttccctacatacgtccatattaaattaccccaaacctctgaacagtagtcttatgacactcgttttaaaaatcccttagtatcttgttcctacttcctgaactaatatcatttgaccacaccccttcgtaatcacaattttttataaaacttaataatttaaagggacatgaaattgtatttaattaagtgctatcacattattttgtacctaacttaggcgaatatatatgtaaaacttcaagatgggcaattactaaattatcctcaatagtttttgttcaacttacttttagaatttaatgttttgttattaaatagcattattttggttactagattattttaatcttaatatgttcttgagtacctctcagtctcaacctttccaatgtatttaattatttaatgtgagatcattatagattcacatgtagttaaaagaaattatacaaagagtttctgtgtactgtataccagtttctcaagtggaaaccaccggcaaaactatggtataataattacacaaccgaatattgatgcattatggtgaagatagggacagtttcccatcatgagcatttctagggcaaatgcagagaagaacaattgtttggtcagatggcagttacgtgtttcgtttttaaaggaaatgtcaaacttcttcggaagttttctgttttctacagaaaatggctgtaccattttatatttccaccagcagtataagagcaaccaattttctccacgttctagccagcatgtgatgttgtcattatttatttttatttcagctattctgattggctgaaatatcatgtgcggtatttctctgtggttttaatttgcattcctctgatgtctattgatgtagagtaaatattcgtgggcttatttgccgtctggatgtcctttaggtcacctgacttttctgcttgttgcctattttctaattggattgtttgccttttgttgttgagtctggagagttcatggtatattctagatacttgtcttttgtcagatatttggcttgcgaatgtgttttcccagtctgcagcatacacttttattctcttaatgcggtcttttgcagccaaagtttttaatttttatgaaatccaatttattaacttatctttttctggtttgtaattttggtgtcaagcatagaaactctgtctagccctagactcaaaagcctttcccctatttttttcctaagagtctaattgctttacattttacatttatatttgtaatccacattgaggtaatttttatataaggtgttaaacttactatttgctatggacatccaattgatccatcataatttgttggtttattctatgcaatttcttttgaatctgttgaaaataaattggagatatttgttcaggtttatttttgggttctttgttctgatccattgacatacgggtttatgtctttgccaatctgccgataccaaatagtcttaaccgttgtagatataaaataagtcttgaaatcaggtgaactgtttctcctgctttattcttctctcgcaaaatgtttgagctattctatttttttttgtttgtttgccttcccacataaattttagaaagatcttgctatatacccaaaaattcttgctgggattttggtggaaattgtgtaaaacctgtgtatcagtttggaagtaacctatatctttacattattgagtcttccatcttccatactattaacatggtatatctgtccatttatttagcatttctttgaactttttcttcagtgttgtgtacttttctgtatacactgttgggcttatcttattgtatttatacagaagcttttctttgagctgttgtgattgatgtatttcagattttgatgtcaacgtgttcattgctagtatgtagaactacaatagatttttgtatgttcattatgtgccttgcacgtttgatgatatcaagtattagctctacaaattttcttgtagattccttggcattttctataaagatcatcatgccaacttcaaatagtagtaattttatttattcctatctgacccatacgcatatattttcttttcttgtattattgtatttgcaggatattccagcacgatattgaataagaatgttcaaagcattcttgacttgttcaaatttcttgacttgtttccagtcttaggcagaagcattcagtcttcaaccactaagcaaaatgttatctttaggcttttttaaattttttttatttttgtagagatattctttgtcaagttggagaagattccttccaatcatatgttactgagaacttttctcatgttcaatgattattattgtcaaatgtttttttctacatagattactatgatcttgtgattttactttgttagcccattaatattgcagattatatggattaattttcaaagattggacctttctaacattcctctaataaacaccatttgatcatcgtgtataattcgtatcttgcctatttctattttctcttacttggttaaggatttttgcatctatatgcatgagagacattattttatttttcttttttctgtgtttatctggttttgatattagagtgtcttagtctctttaggctgccataacaaactactataagttccagggattaagaaatacaggtttattttttcacagttctggagtctgaaagtctgagatcagggtccagaatagtcagttcctggtgagggctctcttcctgacttgtagacagcatccttcctgttccatgctcacatggtcttttctcagtatgtgtccagggagaaaggaatccttctcttttcttatttttaccgtatgcttaccctatgggatcagagtccgaattatttgacatcatttaactataattacctctgtaaagccccatttccaaatctagttatgttgggggttggggcttcagtatatgaattggtgggaggagcataattcagcccataagggaaagggtagtgtcaatgccacaaaattactacaaaagcattctatccacttacactttctggaagagactgtgtagaattagtgttaattctttaaagtgtgtacgactggtgttaattatttaaatgtagaattctccagtgggaacatttggaactggaaatttggggaaagttttaatagctataggataattcatattatgtattttttcattggttagttgtaatagttcatttgtttgagttagtgacccatattgtcttagttgccaattttacatatgtagtttctgtagtaacttttattatctttatgatgaattctgagttcatagtaatatttgatgtttaatgacagtgactctttgtaccttctgaaactcccaattatttagtcagtctttttcaattttattttcccaaagaactggctctttcattatttgttcttttttctttcaattttattgatttctgtacttttcttgttttttgctttctgtttgctttagttttttttgtttttttcttttatagttcttgcaataagaatttggattagggatttgggagtttttctaagctgtgtttttagtgcgactaattaccttctcagcactgcttagctgagtcttacaaagtttaatatgttgtattttatattttcattcagtttatctgtatttttattttccttgagactttctctttggcccctggattatttagaagtgtgttgtttattttccaagtaattagatatttttctgtcatttttatcttactgatttctaatttgattccactgtgtggtcagagaacacacgctatatgatttcagttattttatatagtttgaggtttgttttatggcctcgaatatggtttatcttggtatatgttctgtgggcacctgaaagaaatgtgtactctgttcttgctgggtaaagtgtactataaatattgattaaatactgttatatagggttgatgagttctgtattcttgctggtcttcagtcacaggagaatttaaactcactgttttttgttttttgtttttcctttcttaaagcaacgtttgcttcactgacttgtcttctgtattgcgttcgctaacacataaagtacaaagcagtgtcttctggtatgacaatggtttctttttccattcatcagtcatttactccttcatgtgaatgcactgtctgaaagttgtttggattggcatccaatgggaaaaaatgaacaaatgagtctctttaaggggactgaattaaaaaataaaagcagacagcagatactgcagtttacaaagatgaatacaatttgagagttgaagatccccgtgaattgtaccagataagaaaggtgataaaccaaaagacagggagggaggagggctcctaggagggtgaaagaggacagaccaggcttcacagcacaggagtttgtggattttataacataaaaaataagctacttaccagaatgtgggtattctcagcattcttatgttgggagtcctattgtggatcacagagctgtgtcagcattggtttgccctctagacggctcacagcctattgcacggggcctttgctatcctgaccatctcactcacttttcctaagagcacagcttggaatccaactgaaacacagattgtttcacgaccaactcagtggttttgcaatactttcatgtttgagtgcacaaatgtttatacacacattcacatgctttacctgtcatattttttattagaaaaaaattaaaaatagtgaattaggaaaaatagataatgcatgctgggcttcataccgacgtgatgggttgagaggtgcagcaaaccaccatgacgcaccttcacctacctaataaacctgcacatattgcacatgtaccctataacttaaaaattcaaataaaaaaaaaagttggcagtagataattgccatccaaaaacgaggagcatttaagacaatggcatattatataagtaagtattttcaagaagaaattctctcaagttatttaaataaacatattctcatacttgaaaatgtttaatttcaaatacttaacaaccaaagctatgtgtatggattatctaagtgtttaatgccatatttcaagtgaatataccactgttcaagttattcagtgacttcatcaaataagctttttttgacaaattcatgcttttaactctctttgtgtcttgtcttttaaatttagattatcgggatttcagctgccctcctctatagtgagtacaggatctatcctcactctgtggttcacgacagacttcgctgtgagtgcccaaggtttcaaagcattatatgaaggtaggagattggttgtgttttgcacatgcattcactgtccaaatgatctaatacatgctacactggattaataatgacaaactaggctgctatgtcgcaggtcgttccgtggtgtagacatttggcttctgtgtaatgcaatggcatttggtaacactgttataatcgccaaactttccagcccaaaacgtgttcacaattttcttcttatcactagaacttttcttcttggggttttgttttggttaatttgtagcgaataagttttgagaaatttgactataaactaatagccctcttacgtggtaaagagttcatttttaatgcagaagagtttcattaaatttttggttggacaattatactgatagtgcttgagtaaaggaaatttcattaaatgaacttttgttgtcaaagctgaaatttttaagagagaaaattaatttgcttttactgttgtttgatcatgcaaggcatagagacttatttgttttcatgtcttcagattttgtgcctagatacctttgaggtattgctatcattattaaaacggcttttggcagaaattttttttaaatgcagagatagaactttggaaaaggaaattatcatttcaagtattaggttttaagaaattgaactagttaatactttaaaggccgatgtgtgtctacttttgttttggatggagattttaaattgccttttacacgtaatacaagagctactgtctgtaacagaaactctggagtctgtaaatttaaaaagcaatctatcgttaggggtgtaaaccaattcctatttacaacacacactgtttacttgggatgtcatttgctactaagtcacaaattatatattcttactgggaatactctgcatttaggcaaaaatcgtattttgtgggaagttaaaatatacacgtggtttgtgcaaatgggtggctgtagtgaaattagcagaaaattacagtgtagaaggttctctttgcagagacataggaatggaccgacttatccttttgcttaaagttacgtgtggaataatgctgagaatggtctgcgattctgcctctaatgtctttcatgccaccgcatttgtgcataagccagcgtcagtggctggaaagggtctatcacctttaagtacgttactatcaaggaataagttaatctttggaaagcagcaggctaattgaagatcagtggatgttattagctttcagttttgattgtatcattgatgatatcaatgtaccacttcatataaactctaaattcacatcatttcattttttgcagaatattacaaaagcatctctaaagcaatccataccagctatatgccaggcatattttgtcctgttaacatacaatatttgttcagaaaatagataatgcttccacattttagaaaacttggcatttttttctcccctcctgatgaagttgatagctgaaaaggtggtcttgttagattcccaaaattaatgttgtgaaaactccatcgctgttgagaaatcactatatgaataattctatcaaatatttctgggctatttctgggtttactggtggtcatgatggtataatgaagaaaatagggcaagattgtctatgttggaaaaatatttctttgttactccaaaagatcaactgaaaaactttctagaaaatggaatagggccataagttgagtaacttggatttattttttaatgtggctatgtagaaaatgattttgtggtatttcgatttgaaatggtgatattatagtctgatgttgacaagtgaagacaaacctctatttaaaagaaaaaaacctgtcaaaaaggtgctttgttggctaaaccaaaattgtatctagtatttagtatgtgtgtgtttaaatctatttatcagttagcttccaggtctcctgcaaaaatgagtgtgcgttatttggagaaaaattatcaattatagtcttaagtggaagagtaaggtaagataatctagagtagaagagagcttttatagcaatatttattgcaagtaccaaatactttacacataaactttagacaactattactttccaaggaaatgtcatgggaaaaggtcagaatttattaagagtgcataaaataagcaaatacaccaatttgtacatgtatatatatgtatatgaagtagaattaatgataataattagaaaaatgtttcaagttgatttagagtcacaaaattctctttctgatacctcagatttcctcttttcccattagtttttattttggagagactgcccacggatcctgttatttgacccaccaagtaattggtatgagtcaaataatagaataaaatactgatgtataatccaagacgtataaaggcaactggatttagatataaaatgaactttcatattataataaattcatgtttttttatttaactaaaacatggaattgtggtagtattaacagactgctgcataaaattttaattgaaatgtattggcttgaaaggagaagaatcttccaaagttctaagatctatgtaaacatgataaccttgggaataaacataatccggacaccaaactcaactgttgtctggcagtactttggaataggctttatttacataaactattattcacacatggaactattaagctacataatgagaatagaaacaaattaaaatagtgtaatcaacgtgttcagtcattgaatttaactctggaaatccagtgggaacactgataaattttatactaacattgattatttacagtatttgactttctgaatatagacctcagcaagtctcagcaattaagtgtatatattcaaattaacacattttaactgctaaatatagaataaaattgaaggtagtaacttaattcagtgttgtaagattttacttgctagttctatacttggacattagtcttaattgtgaaccaacatagttgcatagctgtctttgacaaattaataacagaaactattaggattacacatagtttataataagattactattaaaattcctagatatgcccagttttgaagtactatgtctataaattttatttgtgtaatgtttcttcttttatcaaaatctcaagtattaaaaaatattactttgtcatcaagctgacctatgttttaagaaaaacatctaggaagtcagaaaattgacatgagacaaaggctgacacatattagacttgaggacattgaagaaaatatacggactgggtgatacacggtcatctaaaaattgttccccaaagagcctctctctctgatgtactttatatatttttctctttagattttaaaaaggaattcttctattttataatagttgcccttattagtaaaaacgtaagctaaatgttggaaatgcgtgcatctattatcaaaactcttagactcaaaatgttcattattttggttctaaagtctaaatatcaattttaatgcacgtgtttattatgaatataatttcaaatgttttctaaaatatttgggaaatcatacatggacttcaataatttaaatattggttatatttttaaaatctagcttttatgaattatatgcaataatttaggttgactttttagttcattttataagtaaaacaaggtttttcggaagttaattgtattctttatgatccagtagctttcggaaaatagaagttttgtacataatccaacctttctttggatagaaagcagcagctctgaatcaaaacagtgactccggtatttattaactagaatcactacttgctttgtatagaacttttctccatagtgtaaggcaattgtacagataggacacaatttttcataacaattggcaaagactttattcatgtcttttcttaggaaatcttcacggaaattgtctaagtgaaataaggtgatctattattatcacgtagagaaagtgaagtagttaactgcagtactttagtttcccgagatcccatggctgctagggaatgaaagcagaaattatccacatgtctgtacatctacagaagttgcaatccttatacactcactgtttcctcttgtatatattacgtttatttacgtatacacacatacacaaatacatactcaaaaatgcacatacatgtaaacacgtgtgctcatacacattgctatccatacttatacgtgcacaagtgtaagtggatacacagatttgctcattcatttcttctctcatttatttaatcagcattcacggggcctctaccagagacacaatactgagttaagttacaggaatacaaagatgaaatgaatactgcttattgtcagtgactagtgaaggagaatgaaacaatcaaacagaacactggtgtaattggtgtgactcaatagtcattccggctttataaaacagggcggaagagcaagggaaagagcaggtctacgtgggccatgtagaggccatcacagagtgggctcaggccacgacctgaagagcgtgttattaaagcacgtgcgctaaatgcctactttgtgtcaaacccggaatagaaggtctcaaggaagagagacaacagaaggatcttcctgagtaaggaggaatccctgcagaagcatagagaaaaacagatgcctgtctttgagaatgcttagcaatgtggtttacaggaggagggggtgcagaagtgaggcggagttgatggaggctgagttcagtggggagcggaggcggatgatcctgagcctgggttctctggagctcagagagcctggagctgagcctttctgccctatctgaagggtagaaaattgagtttacgttatttcatccttgcaatagaaaacttactccgtgagatcctttgcaaaaaaagctgaattactttcactggactatgaaacgaaggatagcatttttgcttgcctatgcttctatgtgacaatttatcacattttggcttttaagtgatagttatattgtcccaaaataaatgcagggagaagacagaacatggattaaatgaattctgaattcccagagcacttaatggaagccagtagatggcacctcatatgcctactctctggccattactctttgtacccttgagggcaataactaactctaaggaaaatttgaatccttgacacttggcacatgatacatactcaaaaatatttttggataaaaatctgaactcaaccacaacttaactttttctagtagttcatatttcctcaaaacctgaaagaaaaactgccagtaagtattggtattgaaaaatttgaatttgattttctttctagtgaacacacccacgcatgcagaagtttaaaaaaaatcactgaattgatttaaagataaagagattatatgatctatagtatggatcgtagtttattacttataaactatgcataagcagatcctcttaaaaatattgctcagtataggatatgaaatttaatcctcacaaacagaaaatgagggatcagtatttattaatccattgaacatttattttatgaaagaaaatggcctacagttctatacagtccttgaattttcaccagagaaaagtgaatctgggctgctagagagaccttttcttcgggtttcaggaagtgatttaggatgggcggggcttcctcttaccagggtgtcactctgttggctgaatatgtgtggcatttccctctgacacatccctcaagcatgattttctttaacacctgtggatctggatttagaaagagcagctagattattactcttcaagctcaaagctttatttagaatgtcagcactgatttatttctcccttgaagtgataacccaaactccacctgaattaaagcatggagcatgcatgatgcacctggcaggatagaaatgtttccttttcaagaacgtgctagcacaagaagagcagctggctctccattagcccatagtgtaacattgttgtagatttataacaattatagagcttgaaacaaatgcaaaatttcaataattactttcctctgggctaattaggtaacttagactggtaaacccaggtatccttcctgtaaacacattccttcctcatttcataacaagtagaagtagggtcctcaccttagttatctctaggcttagttgccagaagctaccgaaatctctcgtttgtcctccatttgcaggggttttgaacactagctgtattagaacccctaatcaatgttaaatgacattggaaaatactcactgggtaagttcttgggatccgcggtacaccattgcgtgtatagtcaacagtgctgtcttgtgcaactgaatattcgttataagggtagatctcataataagcgttcttgctatgataaaataattttttaaaagaattagtgctgtcagtacatgaacactaacattttctaaaagtagggatatagcagagatataattgccttctgaaagtacagctttaagacaatcaagtcattagaagagagacgctgaactgccctaaagaaacaaatttagctaatctagcgaggcttatgtgctacctgtgacttctaatgtgtcggataaaagaatgaatgatagaattggtttgggcagccccacgagcgtagttaaaagcacagagcccaaggagaagctgtgtcattgaggatcagcctcaaggaaaggaaagcttagccagctcacagttgcaccctgatggttgcagtcaactgagcaaccctccctgggatgtttgtgaatttaaggtgttaactctgattattctggtccactgtgagactgtccatattctatatatccatctttcttaatttgagggccatgaaatatctctttccatgaagctgtgaaattatatgcgtaattttgtaagtctatttttctggaaagaacattgtatagacttcaagttgtcaaaaatctcataactactgaaaagataaagatggcttctgtccattgatgatacaagttctgttaacctgaggcgtcaacttttcttttatctgattgttgtcagttatcttatgtctttctttttcttgttctgaattccttgtttgagcaggcattcttccattacaatttggtttcacatacaggcctagagtgagttaaataaaaataataaaactgtcatatcagtataggtatcaatgtaagtagtctaattcctataagctgtaatttattaacttttcactatgtctttatatgttggttacgtgaacttaatatacatttaaccctgaaaatcttagcatcagaaaatctagtttctgattccgttggaatagaccattgcaacttcattaagagaaattccacttgtgaggctgtattagtccattcttgtattagtataaagaaataccggagactgggtaattttccgataaaataggtgtaattggttcacagttctgcaggctggacaggaaccgtggtactggcatctgcccggcttctgttgaggcctcgggaagcttccaatcatggtagaaggcaaaggaggagccagcgcaacacatggcaaatgcggaagcaaggggaggagtgagaggtgccacacacttttcagttcaattttggtgaatcttttgcgctgtgtccaggagagcaaccgagaggatggtggtaaactattcatgagaaatctgccccaccatgatctagtcacctcctaccaggccctacctccaatactgggggttacaatttaacatgaggtttgcacgttgacagatatccgaactatatcagaggcacattgagatatttagctaatcatttgccctggctaaacacacatgcacacacacgcacgcactcttgcacgttgagaaatatctgaactatatcagaggcacattgagatatttagctaatcatttgccctggctacacacacacacacacacacacacacacccttagctatgttgctgtgtacttttcatcaaaaatcgtaagttctagtactattaaaaataattccttttagtcctatgtgtattgacctcagaagatgtgcatggtacattaaagtgaaaaaaaatgcaacataattccattttggtaaaaatataaataaaagtatttgcatagctatgtgaatgcatatgccacgtgattccattttggtgaaaagataaagtacttggataggtatgtgaacgtctatatgtacaaatacatagcacacatatatatatgctttcgtgagcattcagaaacgtgtaggagaaaatgtgaattgtgaaaataaattaggtttgagaagaatggaatgagcaggtggaaggattgctgtatttttctccgtataactgttatttagctcattgcaatgagcacagaaaaaattaattaatgaatactatagagttaagaaatgtctgatgataatgtgggaatgaatattgttaagtggatctctggctcttaattggaatttgaatgaaaaatagaaccaagtaattaaaagtcctttgctgtgtattttttcaaatggttaatgaattctaagaccagcactgtggctgatttttttttaatgtaagaaatcaaggtgctcttgatagaaatccactcacagaaatagttacttgtctaaaaggaatatagtaaagggcaagttaactccatagagcccatttcataatcaattttcagtaacaaaatatgtattaattaatatttgtacttgatgggtttcctagttcattttatgttgctgtgttacctgagactgggtaatttataaaggaaagagatgtatctcatggttatggaggttgggagattgaagatcaggtggccacacgtggagggggccttgggtttcctcataaacgggtggagtggtatcacatggtggaccagcaaaacgggaagcatgaatgcaaaagaggtaagacacaggggcaacctcactgtataacaatccactgtttcaataactaacctagtcccactagaacaaatctagtctgaagagaaagacattcattgatcttattgaacttataacctctaagccctcctccttccaaacttattacactgacagttaaatttcaacatgttttggtggagacaaaccatattcaaaccattgcagaggggagtctcaactcatgagttgttatactttcatttcttaatatttttcatcttaatcataattttatcttctgtacatacttctctcccaagatttttttattaatttttttccagtatactcttgtgtcaggggcaaatttctccatgtttacatgcatatacattacatttggtaatacataatttcagataaatgaaaaacaaaaattggtcattatttaaaatgaacttcaataagcaaaaatgagagtggatgatgtctaatagtctctttctgtctctcttatacagtaactagaaatcagatgactttctatttaaacaccatcaaatattggctatatactatctggacgctagaaatgcaaagtgttagggaaaattaatttaaatatttacatgtggataagcacatgaattctgaggtgtgggttccatgcagtttcccagtcactatgagtgtgaccattgtgctggtgactaagcgctcattacctcaatttgttttcccttgtgaaatgaaaaataaatggtacctaccttagagagttggcatgaggcttacagaattagttacctaaactgtttggttcagtatctggtatagaaaacttttaatttctccttccatttggcctagattagcctagaagatggcttcaaagattataaagtatgggaccgggtacggtggctcatggctgtaatcccagcactttgggaggccacggcaggtgtggatcacaaggtcaagagtttgataccatcttggccaacatggtgaaatcccatctctactaaaaatacaaaaatttgctgggcgtagtggcgggtgcctgtaatcccagctacttgggaagctgaggcaggagaatcatttgaacccaggaggcggaggttgcagtgagccaagattgcaccattacactccagcctgggcaacagagtgagactctgtctcaaagacaaacaaactaaaagtacggtattgttatttcttccaaattatgtatgatattacattctcctggaacagttatgccctgtgctaatgttcctttgccatcttgggaagcctgtgtccaccttctccttctctgtgctttgtctctttatctggtttatgtgttaaaaaaaaaaaaaaaaaaaagaaaaaaagtcaaataatgatgaatctatactcttctaagtcagagtacacagaacaaattcatccctgctgaagtgttgagtggcatgttctgaattaacaatgagctgcctagttacatattttggttagggttacatttttattgttctcaaatatcaacttaggtagataggcattcttgctgttttttgttgttgatttgtttttattctaaaatgacaagaatatggggtgaaaatcactgagaaagggtaaattatcttttgttagtctgaggcaattcgaggagaagatgtgagagaatgacatagatttggattaagagaagaaaaaacacatatattgacttaacacaaagccgagaacactggaaataagtaggaagtatgtaagttaaggtaaaaatgcattcgaatttcatcaatcaaattcatttccattttgtagataattttttaaaaatctcccatttgaaggtcattttgtaaaatacaggtatagtacattaaatataatttatagccatatgcagatgctaaactttaaaaaaggcttcacagtctgctatccaataaattcaatgccgaatgtgcacccaaatgacaaagtgatacagatatttgttttgtcttcagagttcttaaatcagtcggcaaagaattcacagttcatttccctttctgaatttgaatgcaacatgtaaatttatgatttctgatgttcttgctacctaaagttgatggtttactatcaaacaaggatctgtgtttctaaacgtaagtatatttttcaaaggatatgttagtctaaaaggtttccccctttattgtgctattttttttctttaaatggagccagaaaaatggcagctgatggcctcacctgcacaatagatactctgttgacctctacaaggttcatattctgagagctggtcaactatgggcttattcttggtttcaagaaaatgaactattgatttaattgatcaacttgaaatggtgtcatatagagtacattttccattatcagacatttcttaattgcttccttcacttttcattcattggtgcaaatcagagtaatataaatctaaataggaaaatctttatgtccaagaattgtttagaagcttgagataaagaagtaaaattaagctattaaaaacagtcaataattcatgcagttatttgtattctcccaattcttttctttaaaacctgatcaatggagaatcctttcatagggtaaaatgcctcttttttgacagtagaggatgatacgccctttccagacagcttcccagtttgttttaagtagcttacttgaagacgtttttgacactggttctttcataatataaccttatattctttcatatcctctgaggagagagaaacaccaccaataaggaaggaggaatggcctggggcctgtcaacttgcaacactgatttgtatacatctgactaagctttggtagtcatttaaatcacatgtgtactcgaagtttccattttgtttttccattcaggcataaactttttgtgaagcatgcttttaaatattagaataatggaatggaaagctacatttggggaggggaggagggtgagtaagtggacagctggtgtgtggggacttgcagttttctcctgtgatttttgccgggtgtaggaggataacaaatgggagattttgtgcaggaataagatgctgaacacgtttcagctttggatgtgttatccatcttaactcataaatatgagctttcaacattccacatctgatttttcattttttaagactttcacacttgttcaaaaccttctcatatgccacaatactgacatgtgtatcaaaatttctgtatttacttgactgtttttaaaggaatgcttacatgcatgaatcatggaaaaactacagctatttatgaatatcgtgataacaaatttaaatttgtatgaagttcacaaagacaaaggcactaattaacttgtatttacaatgaattccaatatatttaacactgaaattcctagaaatttaagtgaggtatcatttcatttatacattactatatgaaattagcacaagatatctgtactctgaatttaaacactgtaaaaatacaacagagtacaatgaaatttattatatacaaaattacgttttacaacatacttttgatttaatcacatttaattcaattgtttgaatttgcagcaacctaaacacaagttgccttctagcctgttaaacaagagtcatagtaaaaattgagttttaaaaaagttattgtatatgttttcatttcatcccttatatattatagcagtgattttattcctatgaaattactccaaaagttaaggtcattttttaaacattccattgacatcctgtggcatagaagagctggaattcaggggtgatcactctaaagaggactggcaaacttctttggtaaagggccagagttactcttttggctttgcagctcatctggtgtctgtggtaactacccaactctgctgctacagtatgaaagcgccatagacaatacttgagtgaccttggccgtgtttcaataaatctttatttaccaagacaggggacccgtagctatggtgtggaatcccaaccctaaagctagaacattttcctcgtttaggaaacaagatactcttcccttttaagtcagcttggtcttgttatttaacccactttctcaatgcacaatagagaaagtaaatggccctcaatacgagctgtatttacagtggacattttaatagttttgctgtaactgacaagacaactttgttagtcaccttcatcaaacaccagatgactcaggagttctagtaaattatttttttctttgttggcaaacaatacattctctggtatcatttggacatcacaagcttgttgaaagttttctttgtgtagtttttgtgtaaggcatggccaggaggagtgcccatgcttcctgttgtgtggccagtcccagcctccggtcactttccttggtgtgggtgtcttatctgtctcagaagctcatatgcctacagaaggcaggactctgtgctcctcaaacttcttagaatgaaaagtaatatcaactagtcaaattccttgttcccatctaattaatgcccagaggatgatgagtagatttatcagaaatttgaaatttgtggctcttggggtatcatttttatgaggttggggaagtaaaagttgagtttcatgaatcatctaattgtcatctctctttccctaaattctgtcattttgagtgtgttgaattcacaactggaagcccaattgcaaagggtttgttttgtttgaattgcactatctgagggcaaatgcaccaggagagccacttgcaccatttggggggactttggagcacattacagtagaatgcggtgccagtggaaaaatcctactcagcatatctaaattctaatgtgtgcacgattatgctcactgccatctgacagctgtttggttccgctgtgaaatgaattagtgctgtcattttactaatagaccaaaaataaagttgctggcattgtttccagcagccagttctaacacaagccagtctgaatgaattgccctctcactcgtcacagccatgtctgttacaggacaggcgagcagaacagaaggcattactcaggatactaattaaaggaaacgagatgctccttggagcaaatattaggattgaccaaaaataaccacatgcatttctaaagtggtgagtggatcacttctaagctgtgtcttggaggcacgcactgctccgcccagggcatgtgtctaaaatcactcaacaaactcaaatacagcttaaactgtttctggggtgtctggtggtgcactaacttcaaagatggtttcataagaagcaatagacacatcctgttttatggagcttagcgatgagtgatgtgtctcatgcgaggataatgcaatgccaagcaaaaccttgtttttctttttttcttttttgattgtcaacaaacaaactcacgttttgtatagtgtatttctgaatccatggtgatggtttcatggcacttactataattttttgttaagccgctgtgctgggtgttgcacattgacttcacttcactctttcaaacacaactatagatgggcgttaaaatcttcattttacaattgacaactgaggttaagaaactcgcttatgttcacgcaggtaacaagtagtttgtgccagaatctaaaccatttctattcttaggaaattgagaagaaaaaaaaaatgagaaaaaaactaagtggaagttatttcaatatgctatgataatatcattttccttttttgacttctcttttccaagctaagcatttccattgatgcaaaaccacgggttagtctcctttgagtaaaatacattgtgttgacaaaggatttatggtggattccaggaagtaagagtacttctcctatgtgaaataaccaatgctaaggcaatagtctgaaaatctcttctgaacgctgtaccatggatgcagcattgatttgagaaagtgtccagcatagtcacgacatgctagtttaaacctcagttttattacttagcttttagccttgagaaaatgactaatcctcttgtgcctcggtttccatatttccaaaagaggataatcatatcggatgactgacatcataggctttttggaaaaattcaatgagcgaaataaatgtgaagtgcatggaagtgtggctggtagagtgtaagggcctgttgttgttattgcctcacttactgtgtacccatagaacatatttagttcaagtcttgcttatggctattcaactttcatttatatgtgccatccaaataaatttaaacataaataggaaaatataagtaaaatttaaatattaatattataaacataagtttaatatagtgtaagataaatattaatggatttaatataaattcacattacttaggttggtgcaaaagaaattgccatttttgccattactagctaaaatttaagtgagttttaaaaatgttcatatttaatattaaacatcaccttcatgaaacttattttttgccccccactgctcatctttgtatcactcaatatgcctcaaacatagtttggctttgcaaaaattactttcgttgcttgacaaatatttattgatgattaactgaaacaatttctagagattacatatacagcgttgaacaaaacagcacaaaatccctgcgctcatgggtcttaattccagtggagaaagccacatcataaacaaatacatgattgaaatatacagcatatcataaggtgatagatgacataaatatatagcctatcacaaggtgacagataatataaaatagtagggaagtggcatacggattgtcaggctataggttgagtttcaatattaaatagagtgttccggaaagctctacgctgagaaaaagataaacactcgcgtggaattctggagaaataccattccctaaagcagtaaaagcacgtaaaaagctctggcgtagagtgtttttggataagtctggatgtattttaactttaataccaatcgagtttgctaattgattggttgacctgagaaaggagagttttaggggtgatgccaaaggttttgaaagaggacacttcaaaaggcgaagattggagttaatgcgggtgtgggtaggggatgtgagaatcaggagttcatttttaggcaagttaaatgtaaattcccaatcagacacccaatggcagatgccatttgagcagctagaaatgtaagctgaagtccaggagagaggatcaagatggaaacgtaagtggagttgctagcagtaagatgaggtcatcagcaggcaagaagagagtgacatgaagaggtcaaaagagtattttggttactctaggggttagactctagagagatgaaaacaaataaacaccgactaagtagaccagatggtgaaaagggggagttcttaggagtgtgtactgtcctagaagtcaactcaagcctttcaggaaggaagaggtgatcagccctggcgaatgatactaagtcatgactgatgaggagaggtgatttttcactggatttcaccataagtaggtcattggtgaccctgataaggacattttgagtcgaatggcaggtgtgaaactcttacttctgtggttcaaaagagaattagatgagagaagttagagaggtcaagtagagacttccttataaggagttttgttctaaaatgaaatgtaaggaaatggaatagttgtagaaagggggaatgaagagaagagttatgttcattgttgactgttttgcctttaacgtaggagaaatgatctttatattctcataaggaaaagaaaattggttgagtaatatctttcagtaatcagactaatgtcttatgtaaaagtggaagctttaaaaagtgaggacattttggccgggggcagtggctcacgcctgtaatcccagcactttgggaggctgaggcgagcggatcacgaggtcaggagattgagaccatcctggccaacgtggtgaaaccccgtctccactaaaaaaacaacaacaacaaaagaaaattagccaggcatggtggcaggtacctgtagtcccagctactcaggaggctaagacaggagaatggcatgaacccaggaggcggagctggcagtgagcccagattgcgccgctgcactccagcctggcaacagagcaaggctctgtctccaaaaaaaaaaaaaaaagaaaaaaaaaaaaaaaaaaaagaaaaaagtgaggacattatactcacagcatcaagggcattcagtacagatgcaaagaggtagttgaatgaggtgagagaaggatatgacggctgttttcacattgcttctattttctccatgaagtaatgggcaaattcattaatgaaaatgtgatgagggataggtcttgcaagattaaagaatggggagcagtaatgtaatattcaaagcatcttctataaaagtctcccttcaagagtggaagaataaagaggctgtgagaattgagcataattttggggctgctatatggatgcttgggagaggagtggtcatgaacatacagagagaccaggaagcttagctccatgctatcttccagtcactctcagctgcaggaacgcagcagtaataaggctagcggagaggtcagagccagagaggaacaagggaattgagggtgcagtcaggggaaggagtgtgatgatgaagtatagatttgaaggagggaaagaggagagaaggggcaaagaccgtggggaatgataattggatttgcagtttatgatgttcctggagggaatgagcccccaaaacagagataagagcatgggatgtcagaaagtcgcaattttggagaagtagatgtggttggtattagggctggtctctgaccatatgactaattaatgaaagagaatggaagacaagttcatcggaaggggaggaggttgagaacaaaggaagccatggggttagaaggaccatttagcaggatagtgaagtcaccacgaattataacagtggtagcagcaggaatgtggcagggagtccggtgctgaaattttcaaggagccagtgtatcaaatgcacgggagagcagggtgggatggatggcttcaataagaggatctacatgtgagtaacctgaagacagaagagtcaaagctgggaatttggggggaaagtcaggaaatgatgatgagcagccaatcccagggaacggaggggtgagtgagagaggaagcactgctggacagggctgcggggactatgttcaagagaggggacgccagcttcaggtggaatgttaagggaattctcaaagaaggaggattagatgggaggtgagtttttccggtatttgggatgagaataaaatgagatggagggtcgggtacgacacagaatccgggattcttgtggtgaccgaggtgacagggatggaggacatgatggattggtctagacaggctcaaagcaaacatcagacaggggagctactgctgggagggtagaagctgacctgggaggttctcctctctgggtgaggggatggtgctgcttgggccactggaagcttgaaattacctatgtttttaaaacatgtccaaataatataaaatagttgtggtcataaacaactaacatctgatacacctctttggtgaataaaatgtaataacaatacgtgtgggtttgattggagcacacttaattttattcctgtagaaatattataaaagcactttgacttgattacaggtttcaagacatatatctaatattttaaataagcatacaatgctgaaattcattaagttatttcagaaaccgtttgaagagtttttctcttaatttggatggaacccctgttttgatgaatcctcgactcccagcttcaaacagaagctttatgtggagctgaagaaggttatcttcaattttctttgtaaaaactcattttcttaaaatcaagtatatcatattgcatgctcagcgtatattaactttcagattttaaatggactcagtttcatgttaagaaacacctgttaaaatacttagggaatataagacataatattatctaaaataaagttgtgaagttggtattgtactgagtcattgcaatatacaaaagattggcacctggtaaatccatgttgagttcaatttttctgctattaaataaaaaatgttcttcaaatgccctaataatcctttaaaagcatgagctcatcaatagttttttaaaaaggaaaaaaaaaaaaaaactgatctgtatgcactctattagagagaaactcttagaaacaaagtgtccattaaaaaatctgaaaaaaaaggcaaattagcctgaacggcctaaaatatgggttgtattaaatttaaagacttcaagattgcaggtcagtctggatcccagccatcctatttcaaactccagcagctctaatgaaagtaatggctgatgtggctggccctgtgccttgcacgaaaggcatagagggcaatttttattgacttttttagaactcgtgatgttgctgaacacaagaatttgcgtggagcaaatgaatgaatctcgatgtctgcatacatgcatgtgcacatgtacaaacatatgctcctggaacggcaaacacaggatggatatataaatgaaaagcatttggaagctttgacaatttataacacacacaaaacagtttcctatgggaccaggaactgcgaaatcccatttgctagtatcttacttattttaattcattaaaccagagagccagaacttcttccatgtccataagtttgcaacttccaagcttgcttcaagctgctttctctatggcttgtatttaatcagtaattacttccctaaccacagctatattttcccaaatacaaattactatagagcagagagtatacactattttaatgtactcgtatttagatctctcttttggcatgctgatactgtccataagttaattatgtgtgtgtctgtctacctccactagatggtgtgggaattcacttggaaagaaaggcttatcaacctggtgctaatacattggtccagagagccctagatgaggtctggagaaaaaagccaaccttttacttctcatgagagcttaaaatgatgatatttactactttggtacacttttaatctgggatctttctctcaccttaatggcttagaaaacttattttaatagcttcctaaaagcagatgcatcttttagaaatagactcacatgaggaaaattcaggagcctgatgtataaaacaaaagtcttcattagattcaaggtaaaactgcttttttcaaaaggagtttctgtactaataaattcagctgcagactacaatatgtgctgattgaaattcacattgttgacatctaggatggtgttacaactacaaatatggcaagatccaggggtggtataaagacaaaaaagggggattatgccagttaggtggccaggattcagagaggaaagtttcttgaatgttaagctaaggacattgaacttaagcgtgaacatgaggaaaagccagtaaaatcatacccattctttgaaaggctcatcaatttctcacatatgacgttaacctctttagcccttgcctatgtttgaaactctattctaattattttattctgtaatttagtacttcactatatggtgtattgtttaaattgttttcacatgtagaattgaagctccctcattactaatgatggtcctttgttgctgtttttgtggggaggaattacacacaaggggaaatacggtttgtcatatatttaaacacatagtaaattccaggctaggatcatctttatttattaatctgtatgctgatcacacaaagttttatcattattcccattttaaacacaaaactcttaaagctctaagcatttacatggctaaaagtcaccagctagtgaatgttacgactgagattcttacagaacacttgtctcatacttatttacaaagctgtgtacatattaggtgctcagtaaataattttgactgtttcctggaagaagcttttaaaaaacattctcaagaatatattctggagcatcttaaatggatttgtgaattagagacttttattttttattgagaatgtcagttattttatggtttaaaagtttcaattagacataaaaagaccttgaaaagaaaataccacacaagatagggtcattcataggtgaaagaacagtgctgatcaataattttgataaatgagaaactaattgataaatctgttagcatttgtttgaaagctgtagctaaatgttgcagagtggccgggtgtgatggctcatgcctgtaatcccagcactttgggaggccaagaggggcagatcaggaggtcaggagatcgagacaatcctggctaacacggtgaaaccccgtctctactaaaaatacaaaaaaatttggccgggcatggtggcgggcgcctgtagtcccacctactcgggaggctgaggctaggagaatggcgtgaacccaggagaggaggttgcagtgagccgagatcgcaccactgcgctccagcctggggtgacagagtgagactctatctcacaaaaaaaaaaaaaaaaaaaagaagttgcagcaagacaatttaaaaagaggataattaaaaacttttaaagctatcagtcctaacgaatatttaaaactcatactaagagtagagacgattgtccaccccgaagtagaaataaccacaccacaatattacaacagcctccttggagtgaggcccaccacatactacagatcatccttctacattctcagctacttggagttctgttgtcaggaaacttgtcattgtagaaccacctgctctaaacactttgccagatgtggcattagcaacataaaagatggcatatctcttccttgactgataaagtaatactagctatttgatatttctagagagataccaagttagaaattgataccagtatgtatgacctagacaaaggtatttaaaaatcatctaagtcttttcagtagcaggtgtatgacaacccattttttcctactctagaatgttttaaagaacaagcttaaaattgtgacaattggagccattagaacattggaagaaaattgttttaattagaaagatgtatcctgacattacattattttccgattataaatattgtataattagcatgtaatattgagatacatgtcagtattaaggtttttcccttcatgtctttgttattcaaacatatttgtattttgagattcaaatctagttaatttgaaatcttattaatatctatttcttcatcttactgccgcaatttaaagcagaatcttagaacaagtgatgcatattgtctgtttcattagcaaataaaagtgaatctcaggtgctgcactgtggcctgggcaaaagagcaagattccgtctcaaaaaaaaaaaaaaaaaaaaaaaaaaaaagagtctcaggcttgttgacattgctcatgggcacacagaagtttcatgaaaaccctgcaacagatcacgtatctcccgaagctttcttcatttccatgttcctaatgatttcttattttgaatgaagtaacttctcttttccacttaagattatatctttttcgacttcctctttcatggaaagataatcttcagttgaatatgcttatacatttaaaattagaaaacaatgttctgcttaggtaactaatgctcagtttttatgaaaaaacgcatgctcacacgctaaataaacagaagggagctgttcttgttttttttaaaataggatcaaacacatacatgttgatcatcatgcatggacgtagaaatgagagtgattgctcgaccatgtgatggcgtgcagatggttatatactcttcttagggaaaagagagatggggaagtgtgcataatttgagaagggtaataatttttctttattttttttttaatttcattagatttttagggaacagatggtgtttggttacatgaataggtcctttagtgatttctgagactttggtgcactcatcacccaggcagtgtaccttgtacccaaggtgtagtcttttgtttcccatctgcctcccaccctttccccctagtcctgaaagttgttgtatcattcttatgccttttcatgctcatagcttagctcccacttcttataagtgagaacatacgatgtttggttttctattcctgaggtacttcacttagagtaattgtctccatttccatccaggttgctgcaaatgccatgatttcattccattttatggctgatcggtattccattgggtgtgtgtgtgtatggggagatatatagatatttatgtgtgtgtgtgtgtgtgtgtgtgtatcacattttccttatgcactcattgcttgatgggcatttaggctggttgcagttgcgaattttgctgctataaacttaactgtgcaagtatcttcttcgtatgcttttggcaatcgataaatccagtgcaattcccattgcagagtgagactggctgtcactctgtagcccaccaggctagagttcagtggtgcagtcttggttcactgaaacctctgcctcccaggctcaagcaatcctcctgcctcagcttcctgagtagctgggagtacaggtgcatgctaccatgcctggctatttttttttttttttacttttaagagatgatgtctcactgtattccccaagctggtctcaaacacctgggctcaagcgatctgcctaccttggtctcccaaagtgctgggattggcgtgagtcattgtgcccaactggaaatgttattcttgctttgcaaataattacttctatatttagcatacattcccattacagtagtaaaacttaaaaatactaaacacaaatggagatggtataagacagaaatgggtgatgcatgccaacattatagctagctactccttctatagaattagaacaaaatgattataaaacattccatttttaaaagtaacagaatatatttatctaaagttaatggcataaatggggaatatttcaacggttacaaaaactgtcagacttacaattacacttatatgtgtttctagatacactaccgaattaaagactgtaatggttttcatgctatcattttctaagttaatgtgtatctactttgagggttcacatgcataattgaattgtattctcttcttccacttagcatttttttttacaaatgcttacacagcagaaacatttgtagctgctaattttacaaagactcttcatcatacatgtttgtgtttatgtctccctagcttttggaacagagtcttatcaaaacatttagatagaagtattagtataatgggggcaatattaataattttatcctgaaatctatcctcctcttggcctttctttcagatagttatagctccacgacaggcaaaaaaaaaacagtaggtggggaactggtgtagggagtgaggggtggagatttgtattcttcatcgaaacagtaatcttgctgctattcttgatgagagactgcttttcttgttttttttatgattctttagcgcttctggagcctggctagctggaccagatattgggactactcccctagtcttaatgcaaacaatgctctcagatactaagaatagcgaaggggctgaagttatgaagaattagcaaaagcccttctttgtggtagttctggagtaagagagaagataaaagaagataaacagttgggaggagaaaaccagccagatgtctgatgttctctcatctctggctaaaagaggaggggttgttctaagggagtgtcagaggacagcagggacaaagggcttcagctccactctctgggtctcccagcggaggttcatgtgggtgcaggaggtgccaggacaccctggagctgtccagcacgggaaagggatatgggatatgccacgcagagggaaagggtctacctcctctgctgtgcctcttccctttcttaactgtgaattaactcttccctttcttaacttcttgagctgtgagttgagattcagtgcacctgctgtagaggaacactgtggtgaaaacagacgtgtagacaaggttgtatcggactctctagcccagagaagcacaaaggaccatgaaaaaatccagaaatttaaagtcagctgaaaactaaggtgaggctgcatcaacaggaaggtgcagatggatctgattaagatcaggaaaagagaaaatgtcactctttgatctgggcaacagataagccagtcagggccagcaagacgcccaagggaatagggaaagaaaggagaaattctactactatcacaggagttcccagccctaatgacaacatctcaccttcctgcagctactgggggcatccacagacatgggttgaaccaaagtccatttgctccaaagcaatgagtttaggctgaatgagcgcctcatctcactcattcacacccagaggtatttcagaagggagagaacctgagcagttttcttcaaagactcagtactaaaaatcgcatattgaataggacgaaatattgattgtgttctaagaaaaccatttctagtggagctcatgatggaaacaggacatttagaacccaagagaataactacattctccattaaattattgaaacataggagggtaaacatttttactcaacttcattatatatgtcaatttttatatttgttttcttatgaaagaataaaataattactgtttttctaagacctaggcacttgtctcagaagtatacaacacacagatgtatgttggatgatagttcaaatgaataagctctcaataataatacttagaagataatctggaaaattaatcgttagtgctctgagaggattgaggagtttgtttcagatatgagtaactgagaagtattagcccttcactgaggtgttctttgaaggcagccatgctatatatgtgttgctctattacgtagcaaattggcaaatggcatattctgcgttaatacctgaaacacaggcaatatcttacaatctagctaacggatttaagatggaaaggtatatttcatatgtctcatggttgttccgtgtgctccatgtgtgtacattcctagaactttggaaaagatacagaaacataggaaaatatggcatataaagatgatcagttaaggattgcagctttttctgtttttaaggcaatgaatgtctgaaggcaaatggatcagagattttcaaggtctgctcctggagttccaggttcttggttaattatagtataggagtgtgaaggtgactgggctagtgctcacgtcttttcaacattgataatttaatcaatgacactttaccaaactcattaattggaaacgagagtcagaaggcctttctcttgctgcatgcttatctagctgttgccaagtgaaactgggcctaggatgtatgagatatgtttaaatctacatagtggctgctgccatctcaacataatcatgcatgtgatattcataaaactgcattttgggttctatgtattttccctattaaatgatttcacaaccataactgaatttctccttcagtttcttggccttggcaatttagaaaatgatttttctgctgcctcaactttgtgatattccttttatttctaaagcacctaattaaaaactgctttgtaggccaggtggggtggctcacgcctgtaatcccagcactttgggaggctgatgtgggtagatcaatttagctgaggagtttgagaccatcctgggcaacatggtgaaacttcgtctctactaaaaatacaaaaattagtcgggcgtggtggcacacgcctgtaatcccagctactcgggagattgaggcacgagaatcgcttgaaccccggaggcggagggtacagtgagcctaggtcatgtcactgcactccagcctggatgacagagtgacactccatctctcttttttgtttgttttttatttttgacacagtgtcccaccgtgttgcccagtctggagtgcagtggcaggatctccgctcactgcaagctccgtctcctgggttcaagcaattctcctgccttagcctccctgggtagctgggattacaggtgcctgccaccacacccggctaatatttgtatttttactagagatggggtttcaccatgttggccaggatgttctcaatctcttgacctcgtgatccgcccgcctcagcctcccaaagtgctggtattacaggtgtcagccactgtgcccagcccacagtccatctcaaaaaaaaataataataataataataaccctcccccccaaaaaacccctgctcttttctcatatcctattcaattcatagcaaattcagatgaaagccatttacacaagtttttatatttaagtttcctagtgaccaatgacactcccatctccacacacaaaccgtgattctttaccttttctttggctcaggagtgtttgatgccaatggactgataattcttttaaaagtttacgttctttggcttcatatttttgggagggatttgaataattttgtgtctctgattttaatctctattttctctttactgctcctcctcatgtgaccttccctacatatccgtggtccccatggtaaaacctgccgcttgtgttttattccaggatatattatcagctacatgcaaataactcttcagtttatatcctcacaagtaaattgaaaaatgttagaacgatctgctgtgtaaaaagcaacctcaagacttagcacgttgaaacaaaaatgcccatgacagtttcagtggtcagcaatctggacttgactcagctgtacagattctgctggtctttccttggacactcatgcagctgcagacccatggtgtcccacagggtcgcattgcccccaaaaccctgggactcacttacccactcacaagtttaggattgatgcttggtgttgactaggtctctcttttaatgtgctttctgctcaaggagactatctcagtattcttcatgggagcctcagggttctaagacatctgaaaagaagctctcggcagaagctggtggacatacccagatgagaacagaggctattgactcaggtttgccagaacaagcaaggcagctgccatgatttgagcttagcagccgctcaaactcaggggagagggaaagccctatggtggaagaggggaaggcttcaggcacattgcacttggaggtttttcacatggggaagctggtggtggcgaagagctaagtggaagtaagccgtcttcccacttctcaccagtcaacccagcagtgtatttcacttcctctgcttggtctggagtcaaaagcgggggcaaaaatagggtagctgaaagtcactggccaagtcttacctactctgagctggttgatgcagtggttgtggcttggtctcctgcactggtcacagcagagggtgtgggtcagagttctatgttcatatgtactctgataattagctgtttatgttccttctctcaatcactaaggctctgaaagcctagtcttcaaagtcttacatcactttttctgcattgtagtggaaaagcaagtccatagctcagctcagtcaagggatgagaaggaaacacaccatgtcttaagagaagaaagggtagagttaatggcaaagatgagtgaaagcagtgagtgggggagttatggtggctgtctttgcacacagtgcttcttactgcatgaaatgcaacttttcaggaaacagcttgatgaagaatagttcttgccatacttgcctgagcacaggcattatctgggtccctagagaaacacagatttgtggctgccttcagtttatgtcctcattccaggatctagacaacgaccctagtgctctggggtttaaacaggatcccagatgattcttaggataaaatgaattcctgaagtacaaacacacatatggtagaaagttacagaatctgttttaagtatttgtgtgtctttggattagcagtggttttctactgataactacctttctacattttgggggactaaggacaacatatgaaacatgtgaggtacaccttaaaattggatacttttggccgggcatggtggctcatgtctgtaatcccagcactttgggaggctgaggcaggtggatcacgaggtcagaagattgagaccatcctgacgaggtcagaagatcgagaccatcctggctaacatggtgaaaccccgtctctactgaaaatacaaaaaattagccgggcgtggtggggggtgcctgtcgtcccagctccttgggaggctgaggcaggagaatggcgtgagtccgggaggcggagcttgcagggagctgagatcgcaccactgcactccagcctgggcaacagagcaagactccatctcaaaaaataaataaataaataaataaataaataaaaatggacgcttctgtgggtaacagttttcttaactatgttggtgataaaacacatccaatatgtcatttatcatatctctatacgatgttttatttctcctgttacattgacaacattttagatctcccaggcttggaatgtggtattattatggttatttctcttttccttcttttcccaattaacttcaataagagataacttgattgctcctcgtgacagttttaaaaaagtagttggtttttctttttccccaagaagaaggcacaaaagaggaaacctgactggtcaaaaacatgtttataccagccagactcaggaaatgcaaattaaaacacaatgggatgacaatgaattaaagtccaattgctgagcattaaaaattatggaataccaaatgtttaggagaatgcatagaagtggtaattctcaaattgctctagaaaatgtaaattagtatagcaatttgtgaaaagcaaattggtaatatctaggaaagttaaaaaatattcctaaatgatgagcaagtacatcatgcatgcatatcataggacatacacagagctattcatcctagaattataacagtggaaaactggaaacaacccacatgtttgttagtagggcgggagatatataaagtttgtaatattcatgtagacattatgctttagagtactttaaataaagtagttgtaaggctttacatttttaataggtttcaaaaataaagaagcaaacaatatatttgtgtaactactcatgccaattttaaaatatacaggaaaataaaaaaatcttagaatgtgtttaccccaaattaaaaataaaggtggagtttagggagggaagtggatactacgatttgtggagggatttgtagagaagtttgacttcacttgaaatgttttatttcttaaacatctcttgttcttttgataaattaacattttagtgtcttctgctgagtatatgactgatatattatcctttgtatttttcttttacatttctgagaaaaaaaagcactaaccaaattatgtttgtttgtttctttgttttgtttatgtgagattttcgtatgtttctatggtctaattctggggacctcattaatagtaatttccaagtactccctccacatatcagctctttacactcaccaagagaaggatgacaaggattacatagttatatgatcgcattttctaattctcctggttctgtattcttcatttatgcttaatatatgacccaaagaggagagaaagtattgctagaagtagcccactccctccagaaaaagtaacaggccagttgatgttattttgtgttttaaattaatgaaaagctttagaacagatacacttaatatttatcattctgtacagactttcactggaaacattcctataatgtagagtaagagaaaagcaaatgtaaaataagaccagactaactgcatgcttacttaatgctggttaggtcacacctgaacaattacaaagaacatgttatgttacaagtgtgtgaggtaagagacgtagagatggcaacaggttttcaaagcattagtaactttgaacaaatagctggatgagagaagatgaagaggagacgtttcagctgatttcaaagttttaaatggtttttaaatcaaagggaaggcaggattattcagtgctgggtccagaggtactgggaggatcaaggactgaatacacagaaagacaggttttattttatttttacttttttctgccaagtataaacaagtacattttattttttgttttttccatgagctattggagttcaagtggtatttggttacataggtaagttttttaatggtgatttgcaagattttggtgcacccaccacctgagcagtatacactgtaccctatttgcagtcttttatccatcacccccccacccttccccctcagtccccaaaatccactgtatccttcttatgccctttgtatgctcacaacttacctcccacatatcagtgagaacatatgatgtttgtttttcattcctgagttacttcacttagaaaaatagtctccaatgtcatccaggtctctgcaaatgccattaattcatgcatttttatggctgagtagcagtccatcatgtgttcgtgtgtgtgtgtgtgtgtgtgtgtctgtgtgtgtgtgtgtgtatcacagtttctttatccacttgtttgatggatatttgggttcattccatgattttgcaattgtgaattccactgtaaacacgcatgtgcaaatatctttttcgtataatgacttcttttcctctgggtagatgcccattagtgggactgttggtagaagtaagtttttaaataattacatttagctgggcagagacagctgtatctttagtcctggtttacttctgacattagtccaaatgaggtggacattcattcatcaggaatgtggtaaaatagatgcttggtgtaaatggattcaattatgtgtttaacatgattgtgtcttctgagagtaaaattttaaattaccagacatgaaatcctttgttgttactcgatagtcatatttttttctttatataatcttggcagatacgatttggaataaggacattaaagaatatttgttgacagctgtcatttgtggctatgaaaagaaacctacacggtttgaagtgcatattcaaaatccgtcttgttaattctcataagccttcagataggatttttgaatatgttgtagaaatatgtctattttagctaaaataaagtactattgcctcaaggctgtctctttgtaaaagcccttaattgatgtagtttttcatttttaattattgtaaatggtttcatattaaattcttaaaaatacttccaaacattcaactcttttttttttttttttttttttgccagtttggatttatgcatctcttctgcgtgttgtaaaagataagctcccacagaaatagtatttatgaacaattatgcaagtatgatatgaaagtacactcaacttcctgattatggagaccaagcatatcttgacataatgctttgagtcattacttaattcttttaaaatattttccatgattatttaacacataagaagaaatttgcacttctgagtgtaggctcatttgtcacttacggtaaattgtttcaggaattactatctaaaagtagagtgacttaatttaaaaagtctgctcctatagcttaagaaaatgataattgaagcataaaatatttacatttgtttagacaaagtgagtgacactcagatacctcctagccacaagatggcattgtgttaactcattttccaaattaagaaatttccttcattccgttttacagaaactttccatttatcctaactctattaattggcttttgaaattctgtgcatccgttttatgttttttaatctggatatcccccatgtatctcaaactcagtccctttcaaatgaagccgattactgtcctttcattcatacaatagataatcgtaacatattacacttcatgatttttctatcaatagtattatctgcctcgaagtttccttttaactattcatgatactatacctttttcagtcatccacgagggattcaacatttgctgctgtggtcttatttccgctttacattaatcccaagagcccagaatatttttttattgtatctcttcaactgaaaccaactgtttctacccctaattaaagtcatcattagcacttctctgccagctatcccttaccatctggatccttgtctgcaatacattctgcaagggctcatcaggtaatcttcctgaaaggctgagataactcccatggcttgccagggtctctctgattaaatataaactgcatgccctgccgtaacaggcctttctctcttataggtcttacttattttaggcttgctttaagttcctctttagagttagacaagcaatgggattgagattctctattggagactgggagataaggtggttttgatggacatgtaaagagaggagaatgtctgatagtgtgtattgtttgagtgggatggaagtcataaccggggatggaacttaggagaatgtctgatagtgtatattgtttgagtgggatggaagtcataaccgaggacggaaggtaggagaatgtctgatagtgtgttttgtttgagtgggatggaagtcataaccggggatggaaggtaggagaatgtctgatagtgtgtattgcttgagttggatggaagtcataaccagggatggaaggtaggagaatgtctgatagtgtgtattgtttgagtgggatggaagtcataaccagggacggaaggtttgaaattcccgggtaaaagtcaagattctgggtacagcgagagaagagcaaacacaagaaggtatcacagagaagacaggatggcacagactggagaaatcgtagtgataaaaaaagggaaagttaaaatgaaacagaggaaatgaacttaaaggaaagatgctgatgctctgggttgggtatctgaatgttgaggggtgagaaactctggaattcctggagaactggttctgagaaaattctggcattaatttttaagcatatatttttaaatatccagattttaacagtttcccagaaacacaaaataatttttaagctatgagacattaacactctacaaatacaaacaaccattacaatcgacatgaattcctctttagatttttataattttcaacgtatgggttgaattttctctataaaaatactatattactatttttagcatgtgctttggataatgcctacaggatgatgccaattgtctttgcatctgttactgattcataaatacattaaatcagcaattaataacattcttactccttaaaaacaatacactgtagtaatgtgcagtccaaaaaaatgaaaggagattaatattcttaagactactaatacggtagtactaagctccaaatatctattttaaatatgaatttaaaaataaaactaagaaaagaaacatgtactaagtgaaatcagtgctgtagcaagtgcatgcatttgcccttcagaacaaatgttaaggctggggccacgtcggttatttgtggcagtgaagggcccgttttaggtgactgcctgtcagactacatcattgtttaacatgaacagatagtattttgaaagcctgatgaataaacatcaaacacctatttaagaacttttttaatgtggccgggtgcagtggctcatgcctgtaatcacatcactttaagacgccgagacggggaggatcacctgaggtcaggagttcaagaccagcctggccaacatggtgaaacaccgtctcttctaaaaatacaaaaattagctgggtgtgctggaaggcacctgtaatcacagctcttcgggaggctgaggcaggagaatcccttgaaccagggggacggaggttgcattgagccgagatcgagattgcgccattgcactccatcctgggtgacagaggaaatttcctgatgtgaagatgattaccttgatctggaagccatccagccactctgttgatagtcaccagaaattagagcagttgtatttgttaagatcaaacagtagcctctttctctactcaaattaggtagcataattttgatgttctgtaggactgattagtgaagtcgggaagcccgaccggtaggaattgctgatgtgaagtggcacaacattgctccatagagtgtgtgcacgtgccttggccctgggaaaggcccactcgtgtctgttgctacttaatgttggagggaatatgaaatagcaggttgttgaataacaaaaaaaaatcttctattttatttttcttccagaaatgtatgccttttctaagtagcattgcttacagcactgatacaggggtaggacttcataaagtattgaataaagtatttgtcacagtatcaactatttgatcaacaaattcatagatagtagatagaagaagctttatttgaaaaaaccagcaagtgtttagaatgtattagttttcctttgttgtatattttccaaaagtatttaatattttgtagcttcatagtgatgggcctcagatgcgttgcattgtggtgtgtgcgttgccatgaggtagatttcggaactgccctttatggatcttaattggctaaggctttaccatgttggcaatggcaaaaaaaaaagtctgtaatttatcacttctgtcttgtttgaaatcataggagtgtggtgattctaatcttgagcaggatgtctttcttagagaatcctggcattcccaagggaggaggctcaagtatgataaaagctgaagcctgtgttgatgctttaggtgtgacaggaacaccattccatctgagacggtgcaaaaaaaacaacactgaacaagaccaaacatctgttatgaggcggggggtggtccctggatccttcttgtccaagtgctacttaaagggtatgctgttgagagagctgtttccataaaagagaacgcatttttcttcacggtatcatatttataaacatttatgagtatctaaaatatattttaagatattttcttctttaaaattctgtttatttccatgttattattttcaagttccactttcacaataatttggtattatatatgtagcatttgacacttgaaaaaatggtgatgctgatagaaaaggaaattttttttatctgcacatgtggaatttctcatgggacagggtttttattaggtttcccacactgtaatattttggtttctttctttggaatatttctctgaacactgaagtacatagttgattctcagtttaatcagcacgtctttattaaacacttccatgtttcagggccctgtaatcagatttgaggtttataaatgcttctggtaccacaacctgtctgcaatagccagggcttgttggtgtcctggaataaaattacagacgacagatcactgtgtatgaagtattaggaactactgtgaaattcatggtatctggctggacttaacggaaatgaggcaaggcatgtagtaaatgtagcccccaagtaaacatttccataagcaaaagaaaactctctcatcataaaatcttctttgactcagagatccccccatgcccaccgcctaacattcttatcttgcccttggaaaggaatacaaactgtactagacaatgctgctcagaatctacttccaaaaccaccattaacatactgggtcagtactcagagttatatacttctgaatgtcatctggagctaaggtgagaaattttgaaacaaatcatcaagttgcttagtttaatacacaggaaagcccataatagaggatgatagcattgcttaatcatggagcagctattactcccgaatcctaatgctgacagagaccagaatattccaccaattcttactgaaggcgctgatatacagacgatggtgcgacctctcagttctttgtcatcccctgtatatgcagcttaggtgataaaatgaatgtacaccttcccacttattaactaggtattcttgaacaatttatttaatcttactgcgccttgagctccttgtaggcaaaatgtgtaaggtcgttgtcacaatgtaatgatattggtttaatgcatctgacactgaggggccatcattattattttgtgtttcttttagacacagaatgtttatggacctaacaatgcaaagcgttaaaaacaaagaagccagtaaattcaaatgtatcttaatttacattatttatgctaagacctgatgtgaagacttgttttcctaaacttagatgcaattatatgtatgacctttaagatttaatggatactcaagtcttttaactttcctttaaaggaatgcttatactcagagggttttttataatcctttttgcaatacagtttaaaagaagagcggtgaacagagagtttaggtggttggaatgtagagttaatggtctatattataaagtaacaaggccagactatactacaataggacagctaatttgcttcattcattgaccatgcgctcctctccggaattatctgggaaatgtgtgtcattggtcgaccagtcatgagcactggtgagaaagtgcacatataactcctctcttttttctggataaagaactcaataagccccagtgctgtcaggtcaatgatctttatggctttggtaatggttgtttaatgaaattgagtttccatttgaaggggatattttattcttcctaattatataataacatcccatgaagaatgcatgctttgctttgtcaaagatgtcctttattgaagtgcattctatattaattacagtgctatgtgtcaagaagaggaaagtcatggctgagagtcccagttctggtgtcgcataacagaaattcagaccccagctataccatttcctttttcagggatcttggtccggtcattttaccacagagagtgtccacttagtgcagttattctacacatacttaaatttgttttccctgcagtgggcaagtgtcttgatcactgtatagcagggaaccaaaaaggtccgcaaagagagcctaggtgatgctgagctttggtgaagcaggagatagaaaagatgaaactaagtcatcagcagaaaaaggtcaactagaaaaaggaaaaaaacaaaaacaaaacaaaaaaacatagcatcgaagcctaaagtccatccacggcagcgtgaactttggagatgttgacgcatctgcttctcccacacaacactggggaatgagggttgggggatggttgcctacaaggggtggagggatcagtgggtgttcagggcgggaaccaaggggaagtggtcattgcttttgggcagaattgcaatcatatctccaaaaatacctcctccctaccaacctcaatataatgaccttgttttgtccaaattataggcctgccagttggaagacaatgatctttagcacacgtcggcaccagcccccacccccttttcaatgggttttacgtcaggaaatattcatgggttttccacccctgcttactcttacagccacagggtcatagggtcaccagatgcctcatccattgtgttgggaatgaatagccagtgcaattccccacccagtggtttccccaacctctggaaggctgttttgacgcctttattcctcactcagatgctcccctaatctcactgggacagcattttaaatccgtgcagcaaattttatcagtaccgtagagaactgtaatacatatttttaaaaattgacttctttagttctgaagtcactgacattttattaggttggtgcaaaagtaatggctaaaaccacaattacttttgaaccaacctaatataacccacaatactcacatattccttaacccatttcccatttgccctgagaaatgagttctggcagtgagatacgctttttcttttcccaaatgggaaatgggttaacaataaccacaggttatcagttgtggatagaatatctcaaaatgtataaaacaataatattattactacctaaaatataaaaagtatagtaatatactaataaaataatgagatattaaacacagaaacattctaaattaatgtgccttgctcccaagatttagttttttaaatatactttttgtttcagcacttttacagagaagtcgtgaggacagtatgaagtgctcccatagatacaacatccacaatcctctgttattaatgtcttatgttagtatggtccatttgccacaattaatgaactgatattgacactttaatgactacagtccgtaccgcattgaatgttctgagttttcacctaatgttctcattccatccacgggtcccatcccaaacctcatgtggcatttagtcgtcacgtctccttgggctccccttggctgtgacggtttctcaggttttccttgtctttgatgacctcgacagattggaggccgactggtaaaccattctgtggaaattctcttgattgtgatgtttctgatgttttcctcatgtgttgactggagctatagatttttgggaggaaaactagaggtgaagtgtcattcccatgacaatgtaaggagggtgtgctatcactgtggctcagcactgcagatgctgaccttagtcacctggcagaggtgtttgtcaggcttgtccactgcaaggttactctggtgtcctttttccatactgtagtctggaaagaagtaactgggagccctcctaagggagttacatgccaccttctgagggcagatatgtagaaactatttagaattcaacacaaggaatttgttttatttttctcccatttactttttatcccaatcatttatcttcatatggattgatggatatttaatttataccttgggctacccacattgagtttcagcagtcctctctgcaatactgatgctattccatgtgttttctacaaagtggcgactcttccatctccagagtgtatgctggccgcgctcatggagttcacgtccagtgtgtggaacacggcttccatcagcatgccagcatgtgaacatcactgtctcctagcagggatcactttttcagcaaacagtacttacctcatagaattgtcaacattttgactggaggacttggacctaaagtgtgggccatagatttttctcatttatcatactttctgccactgttgcttcattgccctcttcccgccattgttgcttcattgccctcttcccctgtaagaactaatttcaaaaaaagtccagcagactcattttggtgttaataaatctcatggcttaccttgcaaacatttttcagtttttactttgaaataattttagacaccacaaaattgcaaaaataatacagacatcctatatatacttcacccacttgccttccagtgctaacattaaccagaatgcaattgtcaaaactgaagacattaatgttgacacagcattattaactaaactgcaggctttactggaactcaccaggtttgccactgtcacttttctgttccaaaattctacattctatttattcctcctgtctcctgaatctcctccaatttgtgacagctaattagtctttccttgtctttcttgaccttgacagttttgaagatttctggtcacctattttttaaaaagtcccacatgttgaggctttctgatattttcccataatttggttgaatttatgaacttgggggcagaatactacagaataaatcagccatttccagtgtctcaaattacaggggctgatatatctgttatttcacttatgatgttaacattaattacttggtaaggtggtgtaggctgaatatctccactataaaattccttttttttcctctgcagttaatggatattttgaagaagatactttgctactttcttaatccatctgagctgtgattacaaaatatcataaactggaaggcttataaataataggaatttatcacaattccaggggctgggaagtccaagacccaagcattgcggattcagcaactagagaaagggctgactctctgtttcatagattatgccttctatgtgtcctcacatggcagaaggggaaaaagctcccttgacgtcttacaagggcagtaatcccattcatgagagcagagctctcataacctcataatctcccaaaggcctcaccttctaagaccaccacactgaatattaggtttcaacatttgagcagggacaggaaggggatgattaaaccagcagctgctatccacctattctttttgtcttcaaactcttgttttagcatcctttttgactcaaggtatttgaaacttattgaagaccagtgcaaagctaaaaggaagaatggtcacacggtgacttcagcgaatatgaacagagagaaagagagagagagagataaaggggataaaaactagggagacagagtgctagacagagaataatttttgagatttttacaattgatatcatgctcttctgttttaagccaacttgcgtgcaaacgagtgagctaatttctcatgattatgttccacctacattcattaaatgtcaaagttcaaaaacagcaatttataacaatttaatagttactttgcatggattatataacagggacaatgtattgacaaatgttaatagaaaagtaattttaaggaaatctcatcagtacataacacgactaattcgttggacgccgattagagtcgcaatatctagagtataagtgaataatggaaatattgaagcatgtacactccatgccacccgtaaaatttggcttctgtgttttgcatctacttcaccttcggagtctgtaattgaatgagtagtgggtgttacacttacctgtatattagagggaatacaaataaaggaattacaaatatatttaaatgttgttgacagcactacaattctatcatttgctataatcaatattatgagggccatttgttaagtacctcccaatttaagtactatacaaagtaatccatactaattcaattcatttcggcagtaatcacagttacagaagtatactaattggggcaaaaatatttatacacaaagctaaacaattgtacaacgcttggatatttaaaggtgccaaaaattcttttttcctgatagcctaatagttgttatgggcagagtaagaagtattttaaatcaaaagtatgccacagatgaaatttttaaaagcttaatagaaatatatactttgctaaaaagaaccttataaatgatttcattgaacctctagttttgcacatcataaaattgaggctttgagaatttacttggcttcttcgcaaagtccagcacctttactgactcaactttgagtatatattagttctcctgggtccaaaagtgatctttggagaacctttaaaatatagtcaaattgacttgttagtaatttaagggggaaaaaatcaatttaacctctcacttcgcattgaaaactgaatagatttaagtagtttagatataacgactaaaagaaaaggaagcaaaccattaaaagccaaattagtaagctctaagcctcccccgaccaaggttttgggctgtggtgacttctcctcctcccttttgctctctctgtcccaggggtgatagttgctttgtttaattactaatctcggttaattattttcctcttttgcgctctcagcccttccaaaagatgtgtaatcaattccatgcactataatcccactgtttaaaacacataaaaatgaaaaataaaggagaaatggctctatatgaaaatttagaagaaagaggaatgaaatgtatgaaagcaacagaagcaatgatccaggagaacaatctgaaaccgacgaggccatcccacttgccactgtacctgtgtcccggggcacagcttctgccatgctggtgctcagcacctgtgcggtgagtggaggagtgaacattacccccgttccataaaattgcagtacagtagtgtgtccaaaatacaaaatccaagtcaaatacctgtaaaaatgcataacagagaagcacttacaaataagacaaaatcacaggggtgaggaacatgaaagtagaggtcggacaacagaaaatagagttggttatcaaacaggctgaaaaatattgcagctgggtgaataaagcagtgcaagttaaaatgcaatcagtttgcaaagattaaagaattaatattcagcgttaacaacggtgtgatatgagcacggctatagaatgcaacccttctgaaaagaaatattatttaattcccccctaaaaattgtcagactaactcaatgttgtaacaacaacaaacaggcaaatatatgagataaaattaaattaaaaattgattaaatatactgtggggaaaataatggtctattcatataaaaatggaggttttctttctaaatgatgtttctacagaataagccgaaaatattttgaaacgtaaagaaaaaaatatgcacaagagaatcacagcacgggttacatatggttactcacagtaagtatttctaagagttgagattataggtaacttttattctcttcttgaaaatgtcctgactttctaaattttctacaatggccacaggtcattcttaccatcagagaaaatgctatcagtattgtcaaataggaaaacgtcaaaaacgattattgacaaacagagccagcagaaaataaattcttttgatacagttgttaagcacacttgatgttagagcataaagtttgcagtgcatttccatatcttttgataagctgagtcctacttagttatgatatattaaattatggaaattttcttctctagcttcagtatagatatcaagacttaaagacgggcattttccaccatagacaatcccttggctgctctcagaaacagtgggataagcagcattggcaaggcctggaggttgccaggaaactctctgcacatctaagagcaggaggtggtggccgtatcctgaaggcatttgcctgtgtttgatgggagttgtgtacatcttttatttagatgactgtgaagtctgttttggcttaaaaacattgaactcttaaaaaatgtatgaggatggtttgaagagggggaaatcactgtacaaagacagggcagggcatggtgcaggcagtcgggaagtgaggaggaagaaaacagtcatgcagacctttaattacccctctcactctgtgggcattcctcccttatccttccaccagccgcgaccatcccacagccacaattccacgtggctgttagccagtgagccttcttcctcagtaggagtcttcagttgaaatgctaatgttagtaagaagtgggctaaaatgttaaggaggaaaaaaaaattcttctgatgtcacttgcccatcaaggagactccataagatggactgtaaaactacaaacgggtgaggacagctctggtttcctggggtagtacaagatgcttgtgctcattattccaaaatataatgccctgttttcctctcaaaagtgcccctgtgtggatggtgaataggatgatcaccctcctgacagaccaggaagaaaggtgcttttggagatatgacacttttttgtgtcttttcctgaagtctgtttatggacaactgcatgttttatgtattctaagaccatccaaactatctatccccgtgggcaaagacttgaaaacactccatatttcttgctttcgttattttaccctaacactgtattttcacctatctacagttgccatttttgacttcgttcttcaggtctgccaatgaacatgcctggaaatattcatcactccttttctacctataacagcctcttaatcttcacaaattgctctagctccctgccctgtccccactattgctccttgcccgtacccccactatcgccccccccccccaccccacctttgtctgtttaatcattgttttctaagactctgattagaaacctggaacagatcattggctcttcttcagcttcatgtcctgtgtttaattagcccctaggttctttaaattcactctagactttgctcagcaggccgttttcctgccatcctctcctgggccatcctagagcaggtggccattcattagacaagaaccacttggacgtctctgctgctcatgcttagtctgctccagacacggatgcagctgcttattttcctaaatgccacctttataatctagccgtctactcagaaaacatccagctaaaaaacaacttcatgctcctggctttcaggaccatttcttagctgcttcccttgtcttcccatggctcattcctggacagtgtgagtcgcttgagtgggactgaccagcctcttctctctagatctgctgtgggcattctctcctcactcctgccagtagcaagctgtcttcctttcactccgtaggacagataaagttccattccttctacaaaaagttttttcaggtgccttcagcccctatgactttctttttattattactgatatcccctgacacctataatcagattctgaaaataaagaaaaagattacattgtactgtaattatattgtactctaatacagcataacagtaggtaggctgtattaaaaaaaattaactcacacgttagtgatggtgatgatgttgtggggactgctgttaatccttcctcaaagctaaccctggactggaactcagaggggggatctaaaaggggagggtaaggacgtacttatccagctgatgggtcaataaaatggcaggtgtgaaaaccatgcttcggtcacatatgatacacttcattattgattatattatttaagttcaatttgatcacgtatttttactgagaattctgtcttaatttctgtcatagttcatactggcttttccgttaatggtatatatcaagtctactcagtagagacactaaagtcttctaggtatagagagaaaggggaaattttcattttaatacctcactaacagcttctgcgttaaagcaaaagaaagaattatacatatacatagaaaagctcctttggctagtactgtcttccaggctttgacgactataacaaatttatcaaagagaaaaagtgccccagggagaacctgataataagatggcacagtgttccttccccggagggaaagatgacagtatagaaatgtttccttctaattaaattaaagtgaaacgtttcattaaactatcataacttccataatatttttagaaaagaaatttcagttatgttcatgaatcaccatcgcacataggaaaattaaataagatgaaattaaatgataagagttgagtacgtaatagaagtgagaggaataatgcagtagttctgaaagttttttgctaaataaacttttttaggacagttttagatttatgggaacatttcagagatattgcagtgttttcaaatactccacactctgtctcctctgttgttaacattttatattctggtggcacatttgttgcagttaataaaccaacagtgacacgttattaactaaaaatcctatgtcgcatactttctttggttattacctaatgttccctttctgtccctggatcacacttgacatttacttatcataccttcgtaggctcctcttggctggggtagtttctcagactcctcttgtttgtgatgactttgacagtttggagcagcaccggtcaaggggtatcatgggttgctcctccctagggaggtgtctgatgtttttctcatgatgagactggagtttggggttttgggagacagaccacacaggtaaactgtcttctcatcacatcaaatcagggttatacactgtgagcccgaatcatcactgctgatgctagctgagggctgtccagtgtgaagtcactttatattttcctcttgccacactgcactcttcggaagcaaatcactatgtgctactcatgcttaagggatggggagttacactttgccttcttgagggctatatttccatgtaaataattttgtagtcttctgcactggaaattgggctttcttcctattttatttttatcagtatgcactcaagtatatttattgtacactttgggttatccaatgctactttttttttttcttttgcctccattttctaggtttggacagtgagaactctttcagttagctattgagtcctttgacaggcctgcatcaatgtggctttttgtttgtgatttttttttttttttttaacacttccttactttctgacagtaaaaacgctcaccttgttttaagtgtacctcaaacctagaaacagccattcctccaaaaggctttgaatcattttattggatgaggtattagaggactttttttctgttttttgttgttgttgttttaagtgacacttaactattgcccttgaattgagttcactaattcatggtatacaaaaatatatgtcaaatacagatgaaatgattaccttttgacagcagcaatggaaaacagcatgtggaaggaaacactaagcgttcctccttcacttttaatgctaccacagtctgttctcatgatgtcatttaacccacagacttaataaaatgaaatggagagccgacgttatgtatctttacttcatataaagttttactttttcctgctttagcttataccttaatggctaatactgacaaaaaaatatctctttttggacaagtagaaggttagagaaatgcacatagaaaaatgctaatattcagtaaatggactttgcactgagatagaaagggcttttcttccacctcagccacctactgccatgttcaccccagaccttgccatgacctgtagctatatcgtgctgaacctttgaactcttatgtcttcagtcataacatttccatcacggcaatgagtttatattagcggagctaccacttttcgtcatcattactcttgtgaaatccacacttcccttcttaacttgcatggcctccacagtccacaatcgtaaatatttattttgatcaattcagtttacttgaccctgttcctccactacaattgcttggcagtccaacaacatgaattaaaaaacaatatttgtctattatgtaaccgtaaagaccttaggcgtttgaaaaatacataaaaacatacatacatacaaagtaatgattatatagctaacattctactaactttaagatataagaactttaagacgtaagaaagaaaataagtgaatttgtgcagtaagatgaatttttatgaagcagagaaatcagcattttgaatccatgaatgaaaaaataatacattgctttaaaaaatttataacgatattgtctctttgcataagggaatatcccatatctaatattgaagccttaggtttattatattttctatccccagacatgccctctgctccatttcctccttaaaaacctaatgcttacttgaattaaacagaataaaaatatgtttaatacaaaatataacaggaagtttctctcaaaaccctgcatttaaaactttaacttgcctgttgccagtagtctgtgagtatcttggcctctccagcccagcagaggcgcatcctcaagggactagaagccaaactgctgacctggtcctaatcccccacggtgagagcatgtagcccagcagtgtggagctgagccttgacccctaaagtatccagaaataaagtcattcagctatacccaacttgttctactgtgaaactctcaagggcaataaagaccataaaaacaaaatgccccatctaaagaacagtaacttcaaagggaaatgatgattagccttcacaaaagagaatgaaccactccaagaccctagtaacactaaaggtcagtgtgtcttcttgcctccaaacaatcacactagctcgccagcaatggattcaaaccagactgaaatggctgaagtgtgtcagacatagacttcagaatctggatggcaatggagctcatcaagatacaagaggaggttgaaacagaatccaaggaaaacaataaaatgatctaagagttggaagccaacataaccattttaagaaagaaccaaactggatcttgtgaattaaatttgccacaggaatttcgaaacacaactggtgacattaactgtataacagaccgagctgaggaaagaatctcaggtcttgaacaccactcctttgaagcaacgtgagcatacaaaaattaaaaatgaatttttaaaaatggacaaaacttccaaaaatatgagattatgcaaagagaccaaacacaactcattgttattccagcaagagaaagagagcaagaaacttgagaaacacatttgaacatatagtccatggaaatccttccagtcccattaggacagttgccatgcaaatgcaagaaattcagagaatctccatgagatattatacaagatgaccctttccaagacaatatcatcagattttccaaggtctgtgagaaagaaaaaatcttgaaagcagctagagagaaggagcaggtcacttacaaagggacccccatcaggctaacagcagacatttcagcacaaaccttacaaactgggaaagactgggagcctgtattgaatatccttaaaaagtaattccaaacaagaatttcgtatctcaccaaactaaccttcataagcaaaggagaaatgaaattcttttcaggaaagccaaagctaaggtaatttgttgaaactcgacctgccttaccagactatctaaaaggcatgctaaatatggaaatgaaagaatgactaccaccgaaaaacacactgaagcacatacctcattgacattataaatcaactatacaactaagtctacataagaaccagcttacagcaagatgatagatacaattctcacgtgtcagtattgacccagaatgtaaatgggttaaatgtctaactttaaatgcataaaatacattttacccaaatggaaagttgggtaaagaagcaagacccaactctctgctgtcttccagatactcgtcttacaagtaacaacacccatagtctcgaagtaaagggatggataaagatctatcaggcaaacagaaaatgaacaaacaggagtagctaattctatattagagaaaacgatctttaaaccaacaacaataaaaaaagacaagggcattacgtaatgataaagggctcaactcaacaagaagacaactattttaagtagttaagtcactcaacgtgggagcactcatagtcataaaacaagttcatagagatctacagacagacttagacaaccactcaataatactgggagacttcaatactgcactgacggtgttagacaaatcattgtggcagaaaactaacagatattttgaacttaaccttgacacttgactaattatacgtcagagacatctataaaacactccacccaacagtgatagaatatactttcttcttacctgcacatggcacacagtctaagatcaaccacatgcttggccttaaagcaagtctcaataaatttaaaaaaaaattcaattcataacaaccacaaataaaacagcacaaacaaaaatgaagtcgtatcagaaagacccatcagagccatacaattacatggaagttgaacttgacaccaaatgacttttaggtaaagaatgaaattaagtcagaaatcaaaaaaagtttttgaaaccagtgaaaatggagacacaaaataccagaatctctgggaaacagctaaatcagtgttaagaggaaagtttttagcacttaatgtctatatcaagaagtcaaaaagatcttaaattagcaacctaacatcaaacctagaggaactagaaaaaccagagcaaaccatccccaaacatagcagaaaataaccaaaatcagagctgaactgaatgaaattgaactgctaaaatccatataagagatcaataaaaccaaaagttgatgatttgaaggattaaataagattgatagactgtgagatagattaattttaagaagacccaaataaagacacttagaaatgacaaagctgacattacaacctatccaacagaaatacaaaaaatcctgagagtattatgagcacctctgtatacacaaactagaaaacctaggagactagataaattcctagaaatacacaacatctcatattaagccaggaagaaattaaaatcctgaacagaccaataagttccaaaattgaatcggtaataaaaagcctaccaaccaaaagtcctggaccaaatgtattcaaagccgaattttaccagatgtacaaaaaagagctagtacctatcttactaaaatgattcccaaaaatttgagaaagagggacttctctctaagtcactttatgaaaccagcatcattctgatattaaaaccctggtagagacacaacagaaaaatgaatcttctggcaaatattcctgatgaacgtagaaaataccagcaaactgaatccagcagcagatgaaaaagctaattcaccacaataaagtaggctgtatacctgtgatctaaagttggtttaacatacacatatcaataaatgtgattcaccatatacacagaacaaaaaagccacaagatcatctcagtagacacagaaaatgcctctgataaattcagcacacattcatgttaaaaaccctcaacaaattaggcattgaaggaatatatctcaaaaaaatgatcatctatgaacaccatactgaatgagaaaaagctagaagcactccccttgagaacaggaatgagacaaggatgcgcactttgaccactattcaacatagtactggaagttctagccagagcaatcagccaagaaaaggtgtctcacttcactgacaatgtaactctatacctagaacaccccataaagcctgccagaaggcttctagaactgataaacaacttcagtaatgtttcaggatacaaaataatgtacgaaaattagtagcatttctataccctatcgaagctcaaagccgaattaagaacacaatcctatttaaaaatagcacaaagaataaaatacctagggatataacttaccaacaatgaaaaatatttccacagcaagaattacaaaacactgctgaaagaaatcagagatgacagaaacagatgaaaaccattcagtgctcatggtcaggaagactcaatattgtgaaaatcatcataccacccaaagcaatttacagattcaatattaatatcaaagtaccaatgtcattttttacagaattagaaaaagaaaaaccattctaaaatttatatggagcccaaagagccccacattagctaaagcagtcctgagcaaaaggaacaaagctggaggtatcacactacccgatttcaaactgtactgcaggactacattaatcaaaacatcatggtactggtacagaaatagacacatagaccaatgaaaaatgagagaggacccagaaataaagccatacacctacaatcacgtgatctttgacaaagttgacaatatcagacaatggggaaaggactccctatttaaaaaatggagctgggaaaactgtctagactcatgcagtctggcccggctggacttatgagactggaccccttccttacaccacatacaaaaaataactccagatggattaaaggattcaatgcaagctctaacacaattaaaatcatagaaaacaacctaagaaataccattctgaacattggccttggtaaacaatttatgaataagtctctaaaagcaattgcaataaaaataaaaattgacaagtgggacctattaaactaagaagcttctgcacagcaaaagaagttatcaacagagtaagcagacaacctccagaatgggagaaaatatttgcagagtacacatccaacaaaggtgtaatatcaagaatctgtagggaacttagacaaatcagcaaacgaaaaacaaccctattaaaaaaatgggcaaggacatgaacaggcacttctcaaaagaagataaacaagcagccagcaaaccaaatgacgagttaatgggtgcagcacagcagcatggcacatgtatatgtatgtaactaacgtgcacgttgttcacatgtaccctaaaacttaaagtctaataataataataaaataaaagaaaaagaaaaaacgctcatcagtaactattagagacatgcaaatcaaaaccacgatgagataccatctctcatgagtcaaaattgctgttaataaaaagcaaaaaaaacaacagatgctggtgaatttgcagaaaaaaaagtaacgtttttatatgctgtgagtggaatgcaaattaattaagctactgtggaaaactgtggagttttatcgaagaacttaaaacaggactactatttaaaccagcagtcccacctttgggattacccaaaaggaaataaatcattctgtcaaaaagacacgtgcatgcatatgttcattgcagtgctattctcaatggtaaacacgtggaatcagccacgatgttcaccaatggtgaactggctaaagaaaatgtggtacatatgcaaagtgagacactatgcagccataaaacagaaaaaaaaaagaatcacgtcttttgcagctacatggatgcagttgaagaccattatcctaagtgaagcaatgcagagacagaaaaccaaatgctgcatgttctcataaacgggagtgaaacactgaagacagtgacacaaagtagggaacaacaggtgccgggtactacctgagtggggagggtaggagaggctcatggattggaaggctatctgtcaggtactgtgctcactacctgggcgacaggctcattcctaaatcaagcctcaacaacacacagtttccccatgaacaaacctgtacgtggataccctgaacctaaaaacattttcaaaaaagaaaaaaataataaaactttaaagatgaaatattttgatatcaaaagaaaattactctttaagtagatttttagtgatgtttccttggtggaatctagaaaagtcaaaagatcaaaacctctggagggtaatgccaagagtaatcaggacttgactataaattcggtcaccggagtcagctattcaaatctggaagctcagcctaaagcacgtggcagaaagtctcaggctggatcagaggctggagtttgccttaggttttaaccacaggaagcaactgttaaaattcaccgttagtgttcagagtaaacaaatcaagtacaaagacagaaaccagagtatctgcttgatatcatcaataagaggcacaatcataagtaactgtctctgatatcacagggaatttaatcacaacgcctggattcgtagcactgccctaaggccagtagacttggagaaaaagaacagacaatctaaaaagaaatgttgtcttttatttttccccagaggttaggcaaaattaacatttaaaaagaacacctaaaatacagaaatgtgaaaaaatgatgcatgattttgataatcttagcatttcaattagttgtacagttttcagaatcaggtgtaatcctaaatttatttacacttacagtttttctttaagaaagtaaaattacattccaaactacttaagcattaacaaaactctttttttatatatagacaaggtgcaaatatttattgtgagcaaaactaccaaattcaaaataaaaatatgatatgctgtatattagttcactatatgtctacacacttaaagtatttaaactttttcttgtaaacttgccattacaactgatgaatatggaaaatgtcctcacaattgaaagagaacatatttcataaaatatcatctgagttccattagaatataaatgttttcgagtaaaatttaaacatattaaatcccttgcacgtttttgtcgggtgctttgatttaggttcaatatttggttatgattttagtaacaggcagtgtattatattgattatcttttttttttttttttttttttttttttttttttttttttttttttttgagaaggagtctcgctctgtcgcgcaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccattgattatctttttaaaaaatgttttaactgacaatgtagagtcttctagaaagcaagagaggaaattgtattactaaaaatagattactttggaaaaaacatgaaaaacaaatgaatcttgtatggactagggcaataatggaagctataacagtaaacaggaactgaagaggggaaagctgttttcttaggtaagatttctctttattttaagggccctagtcttatcaagaggaccttaatgttccccttggcttaaagaaagttgtaatcctttctgcccctttgagatgtaaagcatttttaatgttaattaactacttatttttacaataacttattttttaaatttttgtgggcatttagtaggtatatatatttatgaagtacaagagagattttgatacaggcatgcaatgcataataaagacatgatggggaatggggtagctattccctcaagcacttaacttttctgttacagacaattcaattatagtcttagttattgaaataagtacaattaaattattgactacagtcagtcaacctgttatgctagcaaaaagtaggtcttactcattctttcttttttgtacttgttaaccattttcatctcccccctgccctacaccctttctagactctggtaaccgtcctttactctctatgtccatgagttctattgttttgattttcagatcccacaaataagtgagaacatgtgatgaatttataaagaaaatgagatacatatacatagtggagtactattcagccatgaaaaatgagatcctgtcttttgcaacaacatgggtggaactagaagtcactttgttaagtgaaataaccaggcacagagcgatgtaatgctttttaaaggctgcctgccagttgtatgtcctggcaccgtccttcccagggacgttgatgttgtctctttgaaatgggtcctccaggcagatggcgctcctgtttcctacaatctgtagtagggagggagttattgctcttctttcttagctttgcaaacaataaaagtatgcttttcctcctccagagagggggtggtggggaagatagagctggaaagaccctaaatgaggggagcaggaataaaatcctggaggccagaacatttttttatccctcttacgtataaagcatgcacgcacatgcatacacatacgagtacctaaaacagttatgcagggtacctgtagtatagaatttcatgacgggcaggagggaaaaactttgaaaaggctcctttaaggggtgataatggaaaaagaaaattgagaaacactgaccttggtcatcatggaagatccaccaaatacaaaatggtggcatttcctgtttaagcctgtttaggtatgtttgaaactgtctctcacctattatttactctgttgaaagtgtctgatgaagtctctgatattatgatccactgtgacctggctgctctgaagagaaaattcaattttctcccttccgtagtagcagaagtaaatactgaaaattcaaaatctattcaaagactgctactgagatgtttgttgatagcagtttttagatatttggcttaaattacatagacttgtcctaacagtttaagaaataatcttttacatttaattaaattacttttataactcagatgagccatgaatttatagagaccctgataaccaatggggaacaactatcccatattataaaatcaaactacaataataattccctttcatttttaaatttaacttaaaaactaaattgctcagtaagtaaaaactgattacacaacaatgtaaagaaagtccttttctcttacaaatcttatcagtcatcccataatttcttttatttcactgtcctttccttcttgaggccagtagagggggtagcaaactggtgaaaagagaaaagaatgtttattgagcagctattttgtgctacacttcacggggctatattatccacttcccacaataaattaaagatcctgttctatctattgcacaaattaagcagacaaatgaggaagagttctctgaagaaagccgtaatcttatcagcaagggacctttaacaaaactcttcttgtccaaagttacatctaatccctcggacctgagactctgtccccaggctctgctggaccactatgagtgcagggggcagacagatgagcttggggtctcaaggttcagttacaaccccagggccaaggagtccacctgaaggaggaggagtccactgcttgtgttctggttgaaatcccctctcatggaaaaaacaagtcttttgttaaaatctcccaggatcctttggaaaatacagatgtaatggactttttcttcactgtactcatgtaaattgaattaccctctgtcataattctatttttataaagtacttggatttgtaattctgttctcatttgtatatcaattaaattatctcagcctttattttcacaggttccttatgtatcctacctctaatccttgtcttgctttttcttaatctaaggataggaaactttatttatttatttatttatttattttgagatggagtcttgctgtgttgcccaggctggagggccttggcgtgcagtggagtgaactcgcctcactgcaagctccgcctcccgggttcaagcaattcttctgccttagcctcccaaatagctgggagtacaggcgccccgcaccacgcctggctagttttttgtatttttagtagagatggggtttcaccgtgttagccaggatggtctcgatctcctgacctcgtgatccgcccacttcggcctcccaaagtgttgggattacaggcgtgagccaagccgtcgcacctggctgctgataggaaacttctttaaggaaaaacaaaacaaaagggacagcaaagcagagagttgggagtataaaatagggcaactgcgtttcacagaggaacaaacttgaactctacgactttttaactttgtaggaccgtggtcgttacctgatcttgcaggcctccgtcttctaatctgtaaagtggaaatgcaataatgtcgaccttattaggctgtaatgaagataaaatgagttagtttttcagattacttagaagcagtgcctgagacacagttagcccttcatgaggctacattaaatcaattaaaaatcacagatgactgcagatatcagatatatcattatctaatattttaaaaataagtttctttatcttgtattatttatgagtaagtagtaatattttcttttacgccttttccttcctgctttttgagtaacttaggtattccactgaaaaccagttgtctaatttaagcctcacagcttaataagtctaatttagcccattctacaaatgataaagcttcagctcagagattcagtgactatttcagcatccacacagtgtgtagcatgagaactgacaaaacatctgttgggcacgaaaaatccagtttttcttttcaatatagcattaattttaagaaatattttattttaaaatgtcttcaaatattagtcaaatatctactgtcagtcaagtattcctcaagtcccatgaaatgattaaaaagaaattcacctgctatcagaagcctaattctactttcaggggacctgtcagtgctttaccaatattaaagatagataaaggagaccagaagctccgtgattaattgtgtcaggaactgtgagattacgaaccccgaggggccgggtgcagtggctcacacctgtagtcccagcacttttggaggccgaggtaggcggatcacgaggtcaggagatcggagaccatcctggctaagatgttgaaaccctgtgtccactaaaaaacaaaaaaaaaattagccaggtgtggtggcgggcagcctgtagtctcagctactctggaggctgaggcaggagaatgacgtgaacctgggaggcggagcttgcagtgagccgagatcgcgccactgccctccagcctgggcgacagagccagactccatctcaaagaacctgggaggaacaggaagtatgtgcaagaaaaaagaggttatgataacgggctcttctatgacttaaaacacagttaattaattccacaaatactgttttatagatggagtttgcagtaacttacaattagggtaaagaggcatgtgttaatcatgcaacagataagaggaggatttgcacttcccatggagctggatgcatttggggaccactattaagtaaaagcaaattcagggaggtagatgtgtgttcatcaggaaatcaacattagatgagaagggttaccccctaaaatggtgacaaatgccacgcgtttactcggtgacagtcactctcacgtgtagttcatcctctcagatcatcctcacagccaaacctgcagagaggaaaccagacatacagatatgttaagtaacttgtccgagatcccaggcggtcagagacgagaggaactgtatgctcagatggggacagggaagagagctggaactccacaactgggatggcagtggcatttggctaattgagcatcctaaccatgtggaagatctccagtagggaagcattctttcactgaacgttgatgttttaaactgtggttaaaaggtaggggctgtttagaatttagtagtgttgtctctggacttgcactgagtcttgcttccgacagtaggagagatggtgggttcctgcaactagcctgtactcattgtgcgttctttaccaactccttgacgtggacccttggaatgaatgtagaagtgggccaggccacagtgctcctgtctatagacaaacacactaaaacccagagggctgaggattcatacccagaatcaaccacacacatttgcaaggggagcatgactcaaacacaggttcattgactcttgagttaattcagtcttttagaacaccatgtaatctccaaggaacacagggctcttctgcgcaagaggattggaaggagacatctctatttgcaaggttggggaagtctataagagacaaagaggaaggattcaatcttgtttttaaagaatggcttagctttaaattgctcgagaaaataggaagaaaaacaaagcttctctagttaatatgttattgtgagtttaaaccctattgataatttctgtagataattatagtgtttagatatgttgtacctatttggcccctgcacaataatgcactgcagccatatatacacagaatatatctattgaattaaatattcttgaagagtgaagtaatctcagaaggagggacacccctctctacagataatgcaactcatgctctgggacttttgtgaaattgctgataaccaagtaacttattagtgaccgaactgggctacaactctgccttctaaatttctaccctagtattcctgcatttattaatatactatgtgtaactggaatacttcattcgtatcacatgtatattgattttgccacatatataggcatatatgtatatattatatgcctatatatgtcaacttaaatgtgtgtgtgtgtgtgtgcacaagactctggaagtgtagtactgaatgtactaattattcagtttttttaataaaggttcactgtcctgtagttttaggtttatggtgattattggtaaaaccgtgtttaaaagttatttgagcactgaaaccaaggcactcttacgtgatttataacttgtttacccttgccttggctgacaaagctttattgcaacctaattgctttttgaaatcatatacacttatcttgagagatattttaatgattaagctacaaatacctggtttctactcttagaaaaagtatgcaaaataccaagttagcactaaaaggaattcataaattattgcatgatatagttataccctgttagactattactttcagcacactttttctttaaatggccagatagtaaatattttaagttttgtaggccatatcgtcacctctgcatctgcggagctctgctggtatcgcaaaaggagacatacaccttgtggaaaggagccagtggcagctccccccaggccgactgtgtggacactgaaatttgaatttcatatattttcacgtgtcacgaaacagtccccttctttttcttttcaaccattaaaaagtgtaaaatcattctaagctcatgggccttacaaaactaggcagctgtcagatggcaccagctggatctggcccatggccgcgctccacacccactggtaaagcaaaagttcaacaagccccacagtgacattcatttggtacataaaattataacaccccagaagacattcatccctgaataaagtgaacgtcatcataattttgcatgcatggaaattttgagaataaattttgagaataaattaaattggctgatcatagcatatgtatgtatacatatatacatatatacgtaagtatacatgtaaatcagcagcagctactgtgtattcctcaggacagaagttccatgggaaggggagggagatgtttattatacatcttaaactgagtctcattcaggcattacaccactagcaatgggcttttaattaagtatattctctattttttataaatactacaattatacgtctatgattttagcattaaaatatgataaattttaagtgatattactcacacttttaaattttgtaatactattttggtatttctcctcctctgtctccccatcctccttattcttttcatttttcttttacaatatacctttaaaattttggcttgagtatctcttgatctcaaattaattctgattatttgttaagtttttgaagtcctaccatgaagaaaactttaaagttataggaaacctgtagatattgtatttatttaagcatgctatttatttgtatcctaaaggactaatactaagcagaccatggagaatgacagattttttttttccaactgtgcatttccaacttacttagagatggtagtgcagaggaactgtggataaagtaatgccatgttggtgagggcgatggtaggagagaagtatcttggaggtgataaaatataaactcttaatatttctggccttggagtaaatatttgatatttaaattatttgatgaaatacagtgggctcagctctacgatcctgttgtgaatagcttacgcaacaggcatgatatcaggaggaaatgtgagaaagcacaatggccagatgagatctataaggttactttttagtccctgaacctctaattctagcacgtaagaggctctttcaactgaaaacccttagctacttaagaacacactacatgtgtgagcatttgcgtaccatattttatttgagatcatataccaaagtgaattggggttttgatgaccaattcagagttgtaatacataacacagtattattcatattattcttccttcagtaaagatacattttaataactgcatacaatgtaagaattttatagcaattgaaattcgtttatcttcatatattcacatattcacatagctgcaaagtctttcagttgctattatatttcacatattgacatttaaaaagtaatatgtttattcagatttaaagggctaaattcattatagtttcagcctctagattttagaggaaagggcagagatagctgaacaactaggaatgtgcgccattgtcaagtcggtcaggggctgggcctgcaagactgctttgagagaagaactcggttccagtcattcacggccggagaaggtgccctcactgtacctctccattggagagcacggtgagaaggacaaaacacatggaaagaagccctcactaacaggtgtatgtgaactaccttcgcaggaccagaataaagcagacacagtgaaaacagccaagatgcttacaggatagaggtaaaaatggactgaaacagacatttaaaatgaaacatatttaaaatactctaagacttcaacaaaagaacaacatttgatccagcaatcccactcccaggtatctactcagaggaaaagaagtcattacacgaaaaggatacttgtacatgcatgtttatagtagcacaattgacaattgcaaaatcgtagaaccaacccaaatgtccataaatcaacaagtggataaagaaactggtgtgtgtgtgtgtgtgtgtattacatatgatgaatactacttagccataataaggaatgaatgaatgaacagcatttgcagtgaccgggatgagattggagacaattgttctaagtgaagtaactcaggaatggaaaaccaaacattgtatcttcccactgatttgtggcagttaagctataaggatgcaaaggcataagaaagatacaatggactttgggaacttgaggggaagactaggaggtgtgtgagggataaaagacaacatatatggtgcagtgtacactgctcaggtgatgagtgcaccaggatctcccaaacaccagtaacttaagtaaccaaatgccacatgtaccccaatatcatgaaaaaataagaaagaacatccataaaaaaatgcaattctacaaacaaaacaaaacaaaaaaacagctgattcaaatcatgagactcacctgcgctgtttaaatggcaaggcctggttcccatcctccaaagctcctctactttcggcctggaatctagaaatcttcacttccaaacagcagccaggttagtagcacatgttacccatgaatgacactggagaaacagagcttcatgcagggggaaaatgaataaagatgcattgctggacccttaacttggagtgggattggtaggaaactctgtaggctttggaggttttatagcatgcttgcttttcttgaatgatttctgtaagcaatatttaactcagttattcttctgtctgaacactctggtccctcaccaagttttgttgcagttgttatttcttcacttatgtactgaaggagaacttcctttactaaactactgaatgttccctttcattcactctacttttaataaaaatgagtttgagctatttatgctttcctacatgcaaacacataaagaagatacctgaattcgctacttctgttaagaacactcttaacgcgtcatttttgtagagttttgtgtgtgtgtatatatatcatatatacgtgtgtgtgtgtgcgtgtgtgtgtgtgtgtgtatgaagtggtttgttcctgtgtccacaaaaggtatatttatttatttatttgaaatggagtttcttacccaggctggagtgcagtggcgcgatctcggatcattgcaagctccgcctcccaggttcacgccattctcctgcctcagcctcctgagtagctgggactgcaggcgcccgccaccacgcccggctaattttttgtctttttagtagagacggggtttcaccatgttagccaggatggtctcgatctcctgacctcgtcatccgcccgcctcggcctcccaaagtgctgggattacaggcgtgagccaccgtgcctggccacaaaagatctaaacatgggtttgggtggaattcggtggtttctttcaacctgaaaatactcaaatatttaacacacacacacacacacacacacacacacacacacacacacactacattttcctcatttacctgccctctagtgagagctcagaaaccaggtataatactaagtttgataaactttttgctttcatttttctgggaggggggaaatctataaaaggaattcaaacacctgcatcacttacattataaatacaagtgtttcaaaaatatacacggtgacaatatacaaatgttacaaaaattttaaattctgcatagatgttcatgtgtttattttttgagtagacacgttcttatacgttcaaggagaaggtggtaaggttgagtcacggtgaagtctgccatctatgtttagtgctaatgcagccaccagcttttccacaacatcaagtgattaaacattcatgactctgattttctctctgacattccaccccatgtattataattttagctaacgcagatgtttggtgttctctcctagcatgctatttcagttctgttggggaacggtgtattttaatagttacgaaatgaccaggtttgtgaatattagaatggtttcccaacctcaaaagagattatacagttgaaatgtttcatcgccttaataatactgagtaacttggttactttgtcataaaataacaccgtgatctacaatgttgttggtaaggtggaaatatcggaaggctcagggtggtaatctctgaagatgtgcttgtggacatgttgtttgggaatatgctataatttttacatttaaatttttaaaatttactttcaggcgcgttcttgggcaagttaacgagaatatggaagcaatattgccatgcagatttctgaaatgatatatagctgcatagacactggtatggagaggaaaaagcctgaagaatgtgctgaacaaccacgcaggtgttaggaaaaagtgaaacaatatatcatcatagagggctgatgaagttccctaatatacctcaaatgaacattgtgtaaaaacagcttgctgaacatgctcttttccctggcactattgctgtaaaccagatgagccataattaagtgcgggtcactgaggagagaagaacactggttttaatgatcgagccatttataagccagcaaataagtaaatcaaatgtgtgaagggcaaaaaaagaaatctccatgaaccccaacaaaaactgtggttcacaaagaagatttttcttatgcctgattgtgaattctgagagaaatgagtaaaggcagattgagaaggtttagcctgtcccgttgggcgtgactctgctctttagttgccttatgcatgtgcttcaggatatgctactttgggctttattcgtgatctagtatatttcctaggaaaggtctgatttttatattgagatcatatgcagtggattcatttgaccaattttaattaaagaatgtattattcttttctcacactgctaataaagacatactcgagaataggtaatttataaaggaaagaggtttagtggactcacagttccacacggctggggaggcctcacaatcatggtggaaggcaaaggaggagcaaagtcacatcttacatggtggcagggaagagagcttgtgaaggaaactcccctttataaaaccatcagatctcctgagacttactaccagaagaacagtctgggggaaaccgtcgtcatgattcacttgtctccacctggctccacacttgacacgtggggattattacaattcaaggtgacagttgtgtggggacacagccaaaccatatcagagaacataaaccgaatgttatattacttcaggtaaaaaataagtgaagttgacaatatctgattttactctttctacaatctaatatattaagactcaggaaatagtatccagaggaaataattagtcattttaatgttgcattcaaaggcttggtagaatttaccataattagccctacaagctcgtatttacttataaatattttgcctaaatctttctagtgtcattttctgaggtaattatggctgacgatcaatacaaaacaaagagaaacaggtccaatcttgtttgagttcgtttgaaccatcttgaaatggacggcaacagccatgtccacattccaacagtagatttgtctgccatggtttccatcaaatgactcttaaatctcagaacagagggttcttatttgtgttcttgaaagtaaaacttaaaatgcatacgtttttataaatgaccttcataggggaaatagtatgctgttaagctcctcggtgtcactcggggcaaatgacttttctcaaacttagctacttgcaaaatgaagttacatggaaaatgaaaggatgacatagatgatgtctgcattcttttgcaactggaaaatttcatgtttcttcaaacttgattcactgaaaatatgttctggagaatatttccactttctattctttaaagatttttttgagttgaaaaggaaatatttatactggtgttctcattttctgtggatctacagacatatttattgctgtttgtgaattatctgagaacattctaaatgttgaattttaatttttatgatggcatagatagttctattttctaaatcacctggaagaaccctcatgagcaggtgagttcatttccatttagaaccttatgttggtgcttacaattgcattagctctaagtggggcttgcttattcatcccaggcaatgagaacctaagtggacttaatataaaaatgatattctgagttggggccacaggccagtccacctcattctctaatttacaaagtattccagcagtagaaggagagtggctaacactgaataattgtagaccacactgggacacaatgaacttaaacgatcagcattgcattagtcaattccatacccgtgtttcaagccactcatttttttttctgaaaaaaaaaaaaaaatagcataaaggcaatgttaccttgaatgtcagtgtttctacagtttggtttctgtagtgcgtaatccacatacaagtcctgtcgtatataatgaccagggtcctggacatctccttggcctggtgtgttgctctgctccttttgagatgctggattccaagtgcacaaaataagtggcaatttcacatcttctcaagtgggtcttgctcaacctagaaggcctttttcttttccatgtctggctaattcctcctaaggattcaagtctcctcttggaagacatcttgcctgggaagcctttcctataaacctccctcatctcctttctcactcccacaacaagttgaagtctctttcaggatttttgcataaaacatgcattttaaagccaaactgaccggccactttctacctccatgaatctcacaatttaagttctgtcaattttcttcctaatctataaatttggcacagtaatagctatggaactctgctttttagacattattttaagtaactcttcttaccttacttggtataacagccagcatgggctatgagacgagaagagaggagaacaagacgaataaggagatgcctcaaattttcattgaatgtttttatatagctggagaaacatttagcattgaaaaatctcttgttaggaaagatacgttctaatgtttacttcttagaaagacaggatgtagatggagctttaggtatcaggtgaaacttggtacattttattaactcctagaagtcatttgttctttccctaattttttttttttttagagatgggaccttgctatgttgcccggactggtctcgaacccctgggctcaggcgatcctctggcttcagactcctgaagttctggaattactggtctgagccaggcagatttgttctttgatagaggtagccaagacagaactttaatttcgattaagcagagaggcaaaattattaaaagaagctttaaacgatgacttgcagaaagcaagtatgtgtcaaggaaggcggtcctgtaagcacggcccaccttagaatgcacatcctttcccctccatccaccggaactagagccactggcagatagtgtctccacagctaaggaaagcaaagtcatcttgctaaagtaactagatgctgggaatttaaaaataacctacttaaattcaatcagctgccactggatttagagaagagcaaatgtgacttttggtcagcaggagaagtggacaaccttgacatcagtgatgaaaaatacacctttgttctagtaaatttcatgagtcaactcgcaattctctagcccattgcccaggtcagttttgttctgctttttctcattgtaagcgtggaagtgttaattgaataaatgtggaatcaggacattagcctccattcctacctccttcaggctgagagctcactgctgcggtgatcttacctttatgtgtggtttgtagcaggcaaagagtatcatgtggtttggtgaatcaaggttggttgatgagatatagtaaatcagagcatatcatagctgtgcatttcatttataacactattttgatttttctccatttcttggttcacagtttgtgtgcccctcaggtgtgtcagcctgttagacctcaagtagacagcacagtcacctgcagttggcgtcccctagagtgaggcttccagttgttgagacttaggcttcaggcaggtgcctggacgcttgacagagccttgcaattgtacagcaaaaagaagagaaggcttgtaacaataaggaccatcaagatttgatgatttggactgaagtttgggatgaatctgacgtagcagccagtggtggctcataagtcatgtttcagggctgagagattcttatttgaaataagctaaaactaagcctctttagtcaaggaaaagacaagattccagggctcagggaccaaagctattactttggatcccttaagtctacagcatacatttgttttgttaaagtttggcagtataaaggtcatagcacaacctttttgctaatatattttggctccctgtcttttcttaaaggtaacattacatagttaaaaagtaacctaaacttaaaaaaaaaaaaaaaaggtcatatcatattttaattttaagcaattgagacaaataaatatcttaatggaggaaagattcatttgggcatttgaaaaatgtcaaataaatgatcttgtaactgatgattgtatttataggtatgatagaaattggccacatttcaaaatttaccatttagccaaatattatgaaggtatgcaattgtgaaatttcagggagacgtaacagctttctaagacaatttggttgctaaatgttgaagccttctatgtcacctaatataaaaaagcatggtatagagtagaaaggctgttgaaagggaaaaagaaggtagattctagatagagctctccattttctacctatataacctgagacatatcactagttgtaaatctgacttttctctatcattaaagtagaggtgataatatttcctctgcctaccacaaaaggatgctttaagaaaaatgtaaaatacgataacacctacatcttatactcaattctgtggaggtcttagagtgtagaaaaatagctttccactgctgcaaaaattgtttttgaaaaccactggtctgtaccaaataccacaagacaattagcaaacaagcccttcttatagtcattctgattaaaatcttcacttagttctctgatgaaattacaccaaaagcacatatgcaagctctgtattcggattcagactgaattttacttatcttcaaacttcagctcattttgtaatttgagcatttcatgagtcatgttaataatttctaactaaattagcaagaatgtaagatttcggcttgtgtggacagttggattttcaatttttcagtttgtcctgtttttgcatatggtgcaattcaagagtattctgagggcactgtctggttaaggaacaatagctgtgatatcacagggagaaaggcttatgactcaatcagagcaacagacatgtagatgaactaagagcatgttcgtaccttaaaagcttattgatttaactgggtcttggaagaataaatgggttaagggattgaaagaaagtcacattcgtagtttattttctacaattttaactcacggtcttcctaaagacgaagatcaaattctcctggtataaaattcacttaagcggatatgtacgcaaaagagtctctctctctctctctctctccccctccctctccccctctcccctccctcccccacccccaacacacccacgcacacacacatgcatacacacacacagatgcacacatgtgcacacacacacttttatttgtgatacaactctcaaaatctttgcagatacaacttattaagctacctttttgtggaaagaaatatgaagatacttcagcaaatgatcagaaaggcctaatattctgatttttaaaaatacagaatcacttacagttctgtgacctgcaacgttctttaaacacttgtagcgtagtacacttgggtggattccatgacttcgctgctgtggcctcacactcttacaaaggcatccacagaacatgcctttgctcctggttatatctaccttccccttagacatgaagagatagtcaagagcacttagtatgcattgtgaatttcttatatacattttcccagcacaatgccatatccagagatcatatgcagtaaatatgttttaaaaaccgaaaaggtcttctctctttaatacttctaactggtagttagccaagcattcacttttcctgggccactggtttgtttttgcctggtgtattttggagtatgttgtaactaatctgtttttttcctctttatgcatatagtaaaataagtgacgcatgtttgccagtgtagtgcttcccgtgtataaattcttctgtgcctccattttatttttgtgctcctattttatccttgtttatttaactttttatttttttcttatcatggattaactttggaaattacctctgatctgtttttttttgtttctttgaacgagagaagatataatatctgtttaagtgattatagattttatttagagttactaaaactttatccaatacaacttggcaatacatgcttgctaggcactcagaattgagttacgtgctacaggagatagaagggatgtttgtagtaataggagtcattgcaattgcatactgatgtgaaattacactcctcctttcattgcttttgcactagaagactcagagcagatggccaatatctacattctctttggcgaactttaataataggcaacagggaagtatttctgttgagacagccttatcctgtaatgtcattggtaaattataatttagtctcctttagtcttgcaatttccttcttcttcatagatgtggtataagctcttgtgtgtgtttggctaaaatatttaagtaatgttacctattttaaatgataatgtcttagatgtcccaagaaatcaaagagcagagagtatcgattatattatgtagttttgtcctatgctatagactgaataattttatagttgctgctgctgctgtttagagagggccaaggtgagattaccccaaatcgtggatgtctgtttcattttaagcatgatgtaatttccaagtatttctaactcaagattaataagttaggagtaaagctaaaacttgaacaccgatcccagttgtcacaccaagtgctaaaatcattcatctttcctgccttggagaaaaagtaacttctgaggggtcaaagaataggagaaaaatggtcaaaggtgtctctggtctagataattagaggaaataataaaatgaaaactttaagtatcctggagcccttgtcctcagccacaagcaccctccattacaagagagttgaatgttacctaactaaactcactttcaaattagtatttgaggaaaagattgaggtccagccaggttttacaatccagccagaatgacatgttgagagaggtggagatggcctcaggccctcagtctcaatccccttggatttctacagcgggacattgtatccagagcttaccactgacttgtctcctttgaattttgataagaattctgttaatttatttttatatctaaaatataattataaataatacgacatttctgactagcactcatacgaggcaaattagaaaaaaaattcaaaattgcaatgaagatttcacttaccatttttttcttttaaatttgattcctgctgaagattgaaatgaaatcagtcaagaacaataacgaaaagcacgctcaagcccaaagactgaaagttttctgtaactggattttaattcagtttagacaataatgtcatgaggctatcagagcagggatggattatatcaaggatcggcaagccttgctttaaagggccagatactgtgtgggtcatactccctgatgtaactgttcaactcggctgtggggtcaggtaagcagccgcagatcgtatggaaatagatgggcatggctgctttccagtaaaactggatttatggtcactgaaatttaaattatgtgtatctttcatgtgctatgaaatattattattctttggatgtatatttagtcatttcaaaatataaaaatcattcttagcaaatgagctgtccagataaattagcaggccatatttgattgttaaccatagttgaccagcatggagagtttggagtagaaaaacctccaggtcctttctaatgctgaagatttctagttgtagtactttcgtattcacacatgccagcacatggaccatgaacaatctggatatgataataagaatgtaatattccgttattttatactaatgtgaactactgaaattccaaatgatatctagtcagtatgaagagcgtagtttgaaaacactgaggaagaaaagcccctcccttgttacgtcttgactgaatacacagactcatcacctgtctgcctgtcagtgcatgtaacctcagaacactccaatgtaggtcgctgctcgggatgacctccctgtgaaggcacagactggttttgtggaagaattagcattttaacggggttgagatgatagcacattatagttctgatttgcattttcttgataattcatgacgttgagcctttttaaaaaaattacatggccatttcatatcttgagaaaggtctcttccagtcatttgaaccgtgtttcagtaattattttggtactttttgtttttgttttctgtgatttcctcatatattttagatattagtgctttgtccgatgagtgatttgcatatatttcccccattctgcatgttgtctcttcactttgtcactgtttcctttgctatataaaagctttgtagtttgatgtaattccagttatctattttttctcttctttatcctgatttgatcactatacattgtatccatgtatgaaaatactctattgcataagtgtgtataattacatgtcaaaaataacaaaattggaaaccaagcaaggaaaagatttatatgttaccttctagggtgttcaaacatcgttaatcctcatagaaagcataagttcctatctaattttcatgtccatttcacctccaaaccgcaatagctgctaatatatgttagcgttggtcatcaatgcgatgtcttgcatgtaagtggaaatctgtttccactgttttctgcttcttgaatccgaaattactgacaggtttagctccccttggctgccccatcatttctcctctttctaagccccaaccacagactgacttaatcacagaattctgagcttgatgttatggtgtgatgctgccttagaaagaatgaaacattggctagccatttgttttcttcagtccgaaaattccttaatctttgcacattggaacagagaccagctgaccacaacctgttgcatagtgcctgttcttgtccatgacgtatttgagttgtccttatcgctaggtaaatatttttaaaggttctcaaagatcctttttaaagatcagctgctatatatcatatgctaatgtatatttcttgctggtaaacatgtttttatctacaacggtgaaatgtgaatggcaacttttatattcttttgctcaatgatggatatgcctttttatttttaggaaacatttttaatatctttgtgtttattgattcaattcttgagtgcttttaaacaaaccttcctttgagcatagcggtagtgtaactcataacccagcgagtcattgtcatatatatacttatatatgtatatatttatattcttatatacctatttatttatatatatttctgacaatcatttttatgaaaatgaaaaaatagattgagagatagaggtagacatttgtaaaagaatgcatctttgagcagttcagttttaaaatattcctgcctttgctcaacagaagatagtaggtactctctgagcttgagcgtatgggagtatgaaaaataatgtaccaaacctgaaagatgtaaagctgatttgaaggccacgtctgaaatgttttgttaaactagacacatgacagaatgaacaattgaatgaacacgtgtaaagatgattgtgtcagaggcacctttgggaaaacagaggaaagtctccatggagacggttacagagaaatctgaaaatatatgaaaaagcagattaacaaggcatttctcagttgctaatgatcagtgtgtttttgaataggccttttactcgaggtgctggtataccgtgttaagccagagtatgtgtgtgcgcacacgcacatacacacacctatttgtatacattcacaatttcacaaccacagtgcttgtggtattattggcaatggctttactagaatttattgtatatatgaaaatacttattataatttttaaaacacttctcttggcagtatttaaaagtaaataagccttaaaaattagttattgagttgaccagggccatatgctacaggagatgtacgagaaaaacaaattgaagtggtagtgtctcatcagaactgttccacatatttctaatacggaacgtgtaggatgagaaagatgagccccagtgcacacatcaagatgatatttccttatggacctagtcgaagctcccctggtgaaaagaaaaagctgcaaaggtcagatcaccagacacagactttgtctcctaggagatgaccacatgctctagtgcacatagtctgctttttgggttagtttctattagataaaaatatactttattccagctctattgatatataattgacaagtaacattgtatataacttgtacaatttgatatttgatatgcattgtgaatcatgtacgcatgtacatcaccatgatcaagctaagtaacatattcatcaccacacatagtgaccatttttaataatttttttatggttacaacacttaaggtcagctctcttagcaagagaatattaaattcagtcacactgttctatattagatctccggaatgtattcattctcttactaaaattttgtaccctttggccaatatctctctatattcacttccccacaaccactggcaacctccatcctcctgtctgtgtctttgtatttgattatcatatgtgctttttatgctctaacaaagcaagctgaagcactccttgtattttaccaaatacattgcccatttcatgtggcatctgtttttatgttttggagagttataaaataccccatatcccttggtcactgagataccatgtgatgttgaaggcaacttaaaatgttgaaatgttgaatatgagggttggaggaggcacaagtcaggtgcactgcaatctacgctacagcttggaattctctacctgacatctacctgtcagagtctgaaacttacagatcagtgtgcagcatatcttggaattctctaaaacataagtcctttgcttctcctgatatgtcacatgggtggcctttggtgtatctagggtgactcacttcctgctttttctttgcgatgttgtggcaggaacgaaccacctttccaagtcccttgagcttgtattatttttctttttaacacgtcttctgcaagcctgtctactgcggaatgttctccctttgctaacctcctgggaatcattggctctatcgctgggcagccagttcatgtttagcatcacatgtgatgaaaataaataaagaatgtctgcatgtgaatcatattaccatcttttttttcccagtaaccttatggggaagtgtccatctgagaggatcacttactgggcaaatgtcatacatcaggaaaatgtcagagttcggaatgaaacctaccctggctgatttagtcctgtgctttttctgccagtttattgtctgctgttgggatagccagaatagttttcaacagttcagaaagtgattaacctattcacacatttatactataataaacatatgtgatagctgtagaatgtatacacatatttttctgtgtgtgtaatacctatgttttacatacattgcacacctttgaatcttggcttgtggtttaaatatccctctacacacacacatacagagacacacacacacacacagacacacacacacacacacacacacacagacacagcactgctgccaagtttgcataagggaagtaagaatgtggcttggtagacagtcttagattggcttcttgtcttgttagagattgtggagttaccatggaaacatagagatggcttgcgctacttgaactgcaggatcttcaggatgctccaaattcatatcaagaatttgtatcttgagaccaagtcttaaaatgactgcatggtggaaataaggccactttcgtctcttgaaccagggtaatatgtgtcagtccattggacaaagcatagtactaattctaagtacagataatgagtaatcagaaagttagtggtgtggaaggttaacatcagctgtggctgctgggtgaagcatccttctgttattatgcagatgtgctcgttaagtcatgtgaacaaattaatgggcactgaaatctgcacaatattattgaccattattaatgcaccctaactgcctaattctaatttgttgaaaaaacatattgactaatcttaggtttccatttatcttgactgcgtcgctttgctgaaagatgcttttagaacacaagagcatatcctaaacatttttccgtaagttacagtttcactggacaaacagggaaccacagaacgttagtatttcttctcaaaatcacactgtaggaaaaataatgtttccatgggtttgcttcctagaaagggccacattcatgatatgcagagtagtctgtcctttgatcacagagaatactgcttcttaaccacaatgaggtaaacttatcttcaaacattttcctctacattttgagttcaaggctttcttcagtactaaattatttcctgcgatagtgaatatgaatctcagaattcaatgtgaaaaacttttacctagtgatatgattgattgcttaatatatttgagcctgaaatatgcccatatgacatacaactgccttctgaaaaatactggaaaacagttatgtaattgctagtaccatggaaacttgccttcattgcagatttgaatccccaaatatagatgatcaacgcctactaattcaaaatgcttggataggccttgttacctaggcaacgatgtattggaaatgagatatctctattctctcactattctttcccaagttttaccttttacgttgatttagagtatagattctaaagttgaatatgtaattttctgaaaaaataggatgactgtgataatttttaaatccatcagcttgaaataaacccgcagagtacagactacattctctcaggcctagaaatctctccgcttgagttcccactttaaattgtaggtaatattcattaatagttaatatcaaaaatagtacagtgtaattagcaaccaaataattgagattctagaagtgggtaagcagcatagttaactctctagaagcaaccattatgagtttgcttgacagttttgcagagtttgctgaaaataaattttcagtttgttccacgtgctgatattttgtttaaaatgtacttctaataaactccagcctactctctaggttaatataattcacgaccaagctccacttggctcattggcagaggaggcgcagccaagcaagagtactgtgaagaaatcagcagggtgggttttgtccctgaattgcccttggacaatcctgctttgattcatctgacatataataaagtctaaccatgacattggggactcgaccatgaggagttcatcacccctagacagacccataattccttcaaggaatgcgcagcttaattgaggagtttatttggccaatggtaaagcaaactcatgtcaagagtgttattttctacatttttaactagggtgtagcagcccctcaaacctcatcccagccaatgtaagggtttggatggagatgccttgcaaacacagatgactagtctcaaggaaaaaggacaaatcttccaggcttcagtgagaggaaaaggggagaaggcatagcaagctcttcttggcgaaggtgtcattagttttttggatcagaaaaaaaaggtatcaagaaaatagaacatgttaaatgagagccctgaaagaggagagattaacaaaacttctaaggttaactctaatttctctaatacttacgttaccagagtcagtcctaaaacatacggtatgctgctcaacataattttcgctagaagtgcctggttctgttgtccaggctggactgcagtgttgctatcaccgctcactgaacctccaacttatgaactcaagtgatcctcttgcctcaggccccttaggagccaggactactggtgcgtgccaccatgccagaataatttttttaagtttttgtagagatgaggtcttactttgttgcccaggctgatcttaaactcctggcctcaagtggttctcccacctcattctcccaaagcattaggatttttggtgtaagcccctgcactcagctttttctacttcgtataccgtcctctttcattttcttctcactcactcaaacctggaaactgtttggccatccaaacataacatattgaatcatctgatgaatgttttcctatgtgggcaggtaatcattgagcgatttcccacctgttctttgcacgatgaaataaacaaccgaaagttatttatgaaagattcagtagtctttagaaatgtaggactgaaattgaagtcttataaatttaaactctttgtcactcagctccagtatctcatttcgcggtagctttgtacagctgattcaaacaccagcctctcatttacatgaaagagagcctggactgagattagcacagggcatgacaagataaaaaatagattcattatttgaccagctgatgaatctgccagcatagcttgtgaatttaaatcacaaaatggtaagaactgaaagggtttgaagtagttatcaacttcctacttttgtctctggccaagaccataactagattatttcctatggcttattgcctggggtatacttgcagatctcctttgaaggagataaagcctggctcaagaatttattttcatagctgatagcatttgtagttggaatatatttctgcctcagagatgagctcttttgtctagactcagaatccatgcctctactacccaagcaatagttcccggtagatttgaggctctacagcaattgagcctcacagaaaagccttgcttttcacagaatctcaaagcattttctgatcattgactgtatgcccagacctatgttcagatacgcttacccttactttaactttatttatcatgcctctgttgtcagttctagtaaaaggttctcttctaaaccttccataatttcttctttcaaaaagtaatataaagctgaatattaaggcaacacaagagtaattgcaacattaaactaatatcaatatgattcatttgggttcaaggagaatttaatattcgcttatgaattaggcgaaaaaaatctgagttaaaaaaatacttgtagaaccggaactatggaattgtggcttctatttctgactcacccgtgagcacattttatgacagctaaatttatggacctaatttaaagatttaattgctgtgtttctattatgagtatgtcagaggtgttatcaaacccagaaattagttttgaaaatagagtaaactagaaaaagccgaagaactttgaaggtacaaagtacaatatcccgaggtagatttgccatgaacctaaccaggtgtaaacgtccaggtttcttgtttgcatggctctgatgaggtcttgattcatccacactagtatgtacttttacgtaatttgcaaacataagatatttttgtatgtttccttaagagagccctggaacagatcacatacgaggtaaatgtgtaactaactatattcaactactgcattgaactcttgcacttactcaactatggaatattgcaactattctaacttaatattagaaatatgcaagaactatgacatgcatctctaatctaactcttgcattagtaccaatatttttgtaattctctactaccatgctttggaataaaaatcatagtaattctcaaattaattgtacaccaaagttacacataaaagtgcatgtattaaaaagagtatgatggggctttattgaagcagattcttggaataaatctttgcatttccactcagaacacctctatttgggaatacagacattttacagttgacaaaactgatatttaaaaaggttgagaaatgcgatatcattaaatgataaacgatttgttcagtgatggggtcattttgtcttaagctgaagaaaatgcctatttttactcttaaagtctttacgaaggaacaagaagttttataattacctgatttattctactgattaaaaatttatcagagctgtgtgattaaaataactccagcccaatgtaaaggctgtactactaatccattctatgtcaatggcaaatacttgagtgtactcttttaaaagttggcatgcttaaagaaaaaattgtctgtgagaataatctgctgtaagtcaacggaatagttcagcatgacacttgtctaaaatatttactgtccacagaattttgagtttgaagaattgatatgcctcacatgtacttcatcgctgagtttatttttaaaaataatgttacgatctgagtattaattatccttagaatataagaaaaagcaaagcagagatcccatcacagtgtggtttgcaaagacatttagatttaacagagaaggctaagatagaaaagcagtctgaaacaaaatacctgtttactgaagaagggcagaaatgacttaggtggaagtttgcaacaatgtcggttgctggggtaactgggagaaattttgatcttcatggcagagaaaaatgtcaagcagaaattaagcatttagttgccatgatgctatgttttatcaggcagtggagtttttgcctcctgggtaaagattgaaagtctccccttttgagataacactgttgcaaacagaggtatagatagagtagtaatgaaggtgggggcagaagatcccacttaaatgcttcggtctcctgtacgtggccgcaacgttggcaaccctctgggacagtgaaacagatgcagaatgcaatgtgtgggcaaaattcagtttataattgcagatttagtaagcaggccagtcagccattctgggaagaaaacacggcaaatcctgagggtttgctccatttcaacattgtagcctacagaatttctgtattgttattatttattatggaaattaggcaatcccattcccgtatgtttttaacagaattgattattggaaataaatctcaaccccatcttcattccatctctagttactgagagcctgcctttcatccaggcggcatctccctctgggcccagctttgcccattgtggatccagtcaccaagtaactcagagtaattggatcctagaaagaatacacagcctcatctctactttgtcttcgaaggactatgtcacagatgtgaaagctgtgaagtgaagcatgctcatgtgctcatttgtgcaacacaacaaatgcactttgtgtgtgtaaaataaattcatgcttcaccaggccactggaaaccatctagaaaacaagcagcatgacattcatcgaacacgttattggccaggcaccatgtagttgtatctgtgtttccgtgtctgaaggctcaaacatctacacatagcacagatgctgacattaactgaccgggggccttagggtcattccatcaggagtggccatgggtcacgcctagtcaggcacagttgcctgttaatgacccagttgctccctgcttcctaactaaaaatgtgcctttctacagaggctacgtggcattaaaagtaaagcttctgacataaaatactgtctatttttggacgagcaagacctttaaagggtcttgaacctacaggtgcattcatactacctgcattccctgagtcaaccagcgctgaccgcaaaccaggagtatgattattcagggtagagcttaaagtgagaagtttatacagaacaggaaaaatacttacactatttctcatcaattagtggattgtcttgtggaacttaatcattattgaagacagggaggaagtttggaaatctagaagtaagtgtaccaaatcttaacttgacagtgagcggggctgaccctatagtctcatgtatctgtgagagcctccctgtgcttatcctccaatatggggctccctcactatttttgatcatattgcaggaagccctggaggttctccactttctcgtccccctgttctccccagcttagataccccaatcaacccctgggctgagtaatgttgtatcttccatgggatcacaggtaacgtggtatgttcctcttcaggtattgatgactctatcttgttgccgtgagccctattaaggtacactatttgttatttttgagaaacactatattctgtaacaattttgcacaatatacttcatgctcccagcaacttttcattttattaaatatttgaataaatacatgaatcaatgataatcatagagtagttttaaggaaaagttagctaagactgatagtgacaggttttaagctaatttagatgttggtgctgatgttcttacatggcaggtgatgacttcgtttgttcaggacatttgtattctggagtccatataaattccctgatttaaataaatgattctagtaacgagtttctggtgtgtttcagaaagagatggtgcaatgttaatgtattcagaagatgtgtatatccagattcctatagattgaatgtttgtgcctttccccacaaaagtccgaggttgaaatcctcaccctcccggttatggtagtaggacatagggcatttgggaggtggttaggtcataagggtgaagtgttcacaaatgggatcagtatccatagaaaagagagcccaggccagccatggtggctcacacctgtaatcccagcaccttgggaggctgtgaggagggtgaatcacttgagtccagaagttgaagatcaatctgggcaacattgtgtggctctgtctctacacaaagtacaaaaattagtcagatatggtggtgtgcatctgtggtcccagctactaaggaggctaaaacaagatcacttaggcaacggagcttaaagacaagcctggaggacactggttttactgtcatgtgaggatgtagcaaaaatacagcatctgtgggggtagaaagtgggtcctcactgacacctgatctatcaccttgatcttggacttcccagcctccagatcaatgagaaataaatgtcttttctttaaaaacctccgaatatatggcattttgtcatagcagcccaaacagactaaaatgcctacattcaactacacagtagagtcgagcgtatcgttcaagtatctatgcaaataaaaattatttttcatggtaagaattgggcagtataggctttgaggatttacagcttctctaaccatagaaggtataaagctatgtattagtcagcattctccagaggaaatacagatagagaaataaaaatagagatgtctctctgtcatccatcaatctttcatactatctggagagttttattttaaggaattagctcatgcatttatagggactggtaagtcaaaaatcgataaggcaggatgaacactcaggagtttgatgttgcagtcttgagaaagaatctctttggaaaacctcagtatttgctcttaaagttcccctcagattgaatgaagcccaccacctaagggagggtcacctgctttattaagtgtaaatgtcattcacatccacaaataccttcccaggaatacctggaatagtgtttgaccaaacacgtgtaaggcatacttttaagcaccttatcatacacattaagttattggatgatacaaacagaattttaagggccaggcatggtggctcacacctgtaatcccagcactttgggaagctgaggccagaggatatcttgagttcgggagtttgagaccagcttggttaacacagtaaaaccctgtctgtaatcatcatcatcatcatcatcatcataattaatgaaacgatgttgtggtgggtgcctgtggtcccaggtactcaggagtctgaggcgggaggatggcttgaggcagaacattaagactgcagtgagccgtgatggtgtcactgccctccagtctggatgacagagtgagaacttttctcaaaacaaaacaaaaagaaataaaggggaaaaattgtattagaatccccatgttaaagatgaaacaccataaagctaatgagaagcatagagaatatttgcacacaagcaatgtgtttccaggggcagacccaggtcaaggctacctacccgtggcaggcagcggactagatcttggaatctgtcattgtaagcagtcctttctacaactctttctcattaaatggtatcgtagaaaagcacttataaaatgatgtgttctcagtgtgtctagatttagatcactctccttaaatatatctgcatcagtaacaacagcaagagtaataataactaacgcatattgcatgtcatggtgtgcatatcctgatgatttcactgtttaagcactttatgaaatgagagtagtgctgtacacataatcatactaatataatttccaagataaggaaactgaggctcagagaagacaactttttcaagcataggcaacaggtagttgaggagacagaaattcaacccctgtcagccgtccctggagcctgtgctagtaaccctgcgctcgccctttctgtatcatctctctcggatctagatgttcaacagcatctgagacgcttctttcaggtgaggacttagcgtcaggattggctttaatagaattgtgtccagggtcactaggcagggtgtgacttctgttttgttcagaactgtgagtggcatgatatcccaacttgcgaaggattttttgaggaattcttatgttcaatcaggtgttgctggatttcacctgctattttcaaattttcaaacacaattccatcctgaaaaaagtagtatttctatgaaacgctcttgacatttaaaatggttgctgtgtgtgggatgagaaatacattgttgctaggctctttcatatgacgtttacctcaaaactgaaggcagaaatcttagtttttttttttttagatttttataagaaaaaaatgtgatagtaaagtacccttttcaagtcattgtgttgtttttctcaaaaacattcctttgtgtagatgattgggaaaaaacatttcatcagctaaataaagtttccctgaaaacttctcctgtctccacacataactattttgaatttgaacattcatcacatgccattacatatgtgtctaagaatggtaactcacactgaaaaagtacttaatactttttcatgtaatttaatattcccccaggggtgccagctagcaaaacggtagtaatgagagctgcatgtctgtgtatctgaatgtctctgcatatgactctgtgtgtgtgtgtgtgtgtgtgtgtgtgtgtgtgtgtgtgtgtgtgtgtgtgtgtatgtgatatcatgacagaagggtattactggggaaaaaaagcaaaaaccagaagaagagctcctatctgtgaggtgctcagttggagagacagtacacactgtttttacctactcagtgcttactcacaggtgcctagaaagaatttatactatcctcctgccgcatggtaggaatcgttaatttgagtgcaatgctgtcttcctttttcagcgttttggtgatcctcatatgagaaaggactgaaagagcatctccaagagaggcttggagcacagccctttggctccttggcattaagatgtggtggcaatggctagcgttagcttcgtgagggatccgcacctgtttgctcacaaacctcattatttctgtccacagttgtgtttgctccatgacctaagcaacttgacattttcatcacaactttggggtagaattatgcgtggtttcttggcaaaattaaaaatagatgattcagtggagccaaactgataagataaaaaataaaaaccacaagcatccatcattgtttgtgggtttgagtaaattactcagcattttcatttcagatgtgctttgcataaaaatgaaaatgaattccaatgccatggtcatggagactgtaaaaaaatcattacgatgtgggcttttccatagttaaactctctagctatgtattatgtatttttttaagcaaatggattgtgctatgaggaaacagtaataattatttgcttggaggaaaaatactgtgagtcaaatacaaaaacctctcctgggaagacttggcacatggaccgaagctggttaatatttagaaaggtcattgtgaagcctttaggaaaacaaggaacattgaaatgacctaactggggcctctgggatggctaccttttagctttattgattatgactgaggctttcatgacagaagaaagccacagttgccactataaatgttgccccattgtctgcagtctcccagctgtggatttaattcatactgccaggcttacacaaatgagaatgggatacaacaacactgaaacatgtttgaattacaaaacccaaaacccaaaagaaggctggcaaggctctcgttaccagaaaccaggatgtatttttaaatcactgaaagacaactaaccatgaaaaactgtagacacctcgcaacaaacacacgtgacaggaagctttgaggggcggggtaaaattagtctcaaaactgcgtttgcacccaccgtgcagcatgatgcttctgccattcagcaccttgtgtcaccgagttccctggcttctctctgaaagaggttcccacagggactcacctgggaggcagtaatcttgtcaactatttgaggaagattttctggtttattcttatcaggcaaataatttggggaggatagttcggtagtttagtttcgggaaatatattttcattttgctattatatgtagttgcatattggagaataagaaacaaaaattatgaagaaatagttattgaatctgcagtatgtgtaagataatgcactaagaacttacggcacagtaacacaaaggcggctgtatatgtcggggggtcttgcatttagttataaaaatgaacatggggaaaagtgaatccaatgtagggtgctgggcatacataatgaagctttctgagagaaactgacattcctgctgagctgtagaatctgggaaggtgggatatgagctgcatgtgcaagaatgaacagtgcttcagaagatagatagggaaagaaatgataagtagggaggagatgccgcaggaaagacaggaatgcagataagtcacgaacttgattggggtatcctcaacctacagaaaattgagcaaacacctaggagtgtaaaacttaaaggcataagaggttgtgaaaacaaataaaatatgattagatttatgagctattacaaaatactttttttttttttgagacagggtttcactctgttgcccaggctgaagtgctgtggtgtgatcttggcttactgtaacctctgcctcctcggttcaagtgatcctcctgtctcagcctcctaagtagctgggtttacaggcacctgccaacatgcatggttcatttttgtatatttggtgtgggatttcttcatgttggtcaggctggtctgaactcctgacctcaagtgatctgcctgactagtcctcctaaagcactgggattacaggtgtgagccagcacgcccagcccaaaatattaaattgacaatatagtgttactttgtagaagagtacaaccagacagagtcctactggatctgacgggtggatctgacaggtggatctgacgggtgttatggagaaattgtggatttcataacaggaacctctgttcctgttgtatatttgttgggatactactcattgtgaagtcttaaatgtagtcaaatgctgactatattggactgttcttgcattgctctaaagaaatatatgagactgcataatttatgaagaaaagaggtttaattggctcacagttctgcatgctgtacaggaagcatggtgctggcatctgcttggcttttggggagacctcagggagcttccagtcatggcagaaagcaaaaggggagcagacacctcacatggccagagcaggaacaagagagaaagagtgtgtgtgtctgtgtgtgtgtgtgtgtgtgtgtgtaagcagggtggtgccacacacttttttaattgaccacatctcatgagaacttggagcaaaagctcactcatcaccaaggggatggcccaagccattcttgaggaatctgctcccatagtccagatacctcccaccggacctcatctccaacactgggtatcacatctcaacatgagatttgggtggggatacagatccaaacgatatcactgaggtttgggcatacatgtaagtagtaaataaagaaaaataagtattttttggcaacgtgcggtggctcacacctttaatccaagcaatttgggaggccaaggaagacaaatcacttgaggtcaggagtttgagactggcctggccaacgtggtgaaatgccgtctatcctgaaaatacaaaaattagccagtgtgctgacgcctgcctgtagtcccagctacccgggaggctgcggtgggagaatcacttgtacctgggagacagaggttaaagtgagctgagaatgcatcactgcactccagcctgggtgagatagcaagactccatctcaaaaaataaatgagtatttttttgttcaagcattttagtaataggtctttgtttgtattctgtgcatatgtcaacactgataaggtccaaataatttgtattggaaacatctctatacttgttattctccattatgggcttgatgagaaccgtgcattcaagacagataacacacgtttggaagccatacagtctgtagacgcaatacaaggcttggatttatttgttgtgcaatttttatttattatgtgattattctccagggcttgacttacaaaggaagattgatgttggaagcccaagaggaatagtaaacacaaaaataaatatcacagaagagtgatactctgctaaacttgcaaatgcattgcaaaaacagcgaatgcaaacaacacactaccaatatatacaaatgaatgttatgaggacattttatgagtttcagttataattattctagcaagaattgcttaagcttctaaaaccacagtgttatttttggaagtttatttcaaagagaatactttgtcagattgctaacttaaacgatgtaacttttttgataaaacaagaacagtaaagaaatagccatagtatagctaataaagcacttcctagtaggttgaatatgtagacatgcctttcaaagagaaaaagtgatgttattcttggtaagtaagcatggtaaatatttcaaaacaaaatgacttcatttttaattttttttcatttttttaaattgttgtgggtacatagtgtgtatatttatagagtacaggagatgctttattaccaaaaaagcaggaggagtatttctaatttttgtaagtcccctgttaactgttaccttatgtgtgacaaccgaaatttgtataaattaagaaattaaaactactcaaaagtagaaaccagaagtaataaaaagaaatcatgcctccatagcttatgtgcactaagaaagagagaagtctcagaccgcacagttgacttaactgagtcgtggggaagtggtaattcacagttaagaagagaattcctctcaaaaaaaaaaaaaaaaaaaaaaattgtattgagtgcaatgtaattgggtgtgtagaatttgggtcaaatacaagcttacttactgtcttataatgtgacctcgaatgaggcatttaacatctttgagtatttcttcattcataaatggacatagtgacttgtttgcatagtttctgttacatatcatgtaaattatggagtgcagagcttagtacttggatcaccaataactgacgctaagtacctcttatcatttcccaaatgaataaagtttactggtaaatgttaaaacaagaatttcattcaacttctagatcacagtggaaaatgtgccaattatgtggtgagcaaggaaaattagggacctggaagcaaaaggaaagattttaaagttttttgttttacaaaatgtgtcatctttcaaacaaaaatgtaccttactttatacttacaggagacattttagcaagaaaagttacatttggttttatgattaaataaaaataatgtatgtaacaatgttttcggacagtaggtctcttgttattcattttaaacttctaatacctatgtgtaaacaaaatacattctagaaacatgcatcgtggagctttttgttgttttttgttgttgttgtttttgggggctttttcccctttctgacttggtaacatctttgtagtatgagtgacagtgatgagcgccccacaggaaagccaacattggagctggaacagcctgacacatcacactgcaagaaaggcactcagcacagagaatggctcatccccagttacctacaggcagcaacctggaggctgcaaacaatccgactgattgtgccagtgttctgcaatttgcccaaggaaatacattagcagagtctccccattttcattaacctttcttttaactctctgcctattctgattctctcttaaaattgctcttgaaaagaaggaagagaaaaatgtaaaagagatacttaaagagcaattgactgtaaaatggacgtttgtattaaacactaatgaaaactaagctatatcatttttaaagatatgtaatgtgttatttctgcattatatatacaataatgtatctaacatttgttgtctagtagaccttgtcaatgataacagatattacagctggattcccctctcctgttcaagaatatgctacaacctcatctcttatttgaagtcgtcttctgagttggaatccataccactgaccttctgtggtctggttctcccaattctttcgttttccttctcaggttccttcattaacctattttttcacctgcacttccaaagtagacattccttgagattatggctcctaacttacttttcctcctatacatggtctatgtaaaatagtccaagttaaatctttcccaaagcttcacctgtgacctttttttttcagaagaatctcaaagccaaagttttcttggtgatttcttagctgaattccatttctgcgtacctcatcttcttctgaagatgggcattactattccatcaagtccccatttggtgttacccaaacggaatgtttcatgttcttgagtccagaccttttcctttggtctttgaggaaacgttgggtagatgcttttatcctatatgttctgaggtttcttactgttttctccgtaggagagaaaaagaagtttggaattgcttctaacgttcactttcctttatgcccacctttgattactcattatgcactacctctcgtttatggaccttttttcctatctcctcttgatacttccttatgtcaagcatatatgcattctttacctcttgctcagtagctgcctaattggttttcccatctttttatctgcgctgaaaatctgagtgcctctcgccacattggtgatcgtcgtcaggttgccccatgtctgaaatcgcaagccctgtattttcaaaggacttatccgctgtccttgctatgtctgagtctcccaccgtatgtgaagatgatctgcagtctttggtcatcttagaccaatggttttcaaagcagtgttcccaaatcggcagcattggcatccccagggagcttgttagaaagccaaattctctggcacaactctaaactgaatatttcagaaacgctgacggtagggccctgagctctgatttaccactccgttctggtaatgctgatgaatgctagtgttggagaatcccgtgttaggtcaacaaatattgctttaaaaatagcgagccaacgtctttactgagttcgtaccccaggtgaaggaaattgtgctactgtagactgatatgaccgtgaacagaaaaaggtgccccagccagcatgtaaatctgctctattatattctgaccatgtgcatatacagaacggaactctcaattccagccatcaggtggaataagcttttgttaatctacagtcgttctcagggtcatcagcattttaaatgggccagcatttaaaatgggaagtggagaggggtgcaacaggaataacattcacgccttctcagtgttggattccatctataatcactgagttttatcctgcatctcgctttctggccctagagatgagcatgatggttgttgtgtaatttgggtagtttgggaaaaaatcttcagatgctttcatgttgccctgcctactataataattcttacctcaccggaaaagctaacaaggtaggcatgcttttggttgccatggatattcatgcaaagtgagtatgcaaaaatgagcagacaaacttcagccacaggaagcgcttgaaagtagacgattcttacatgaagtaaataccatgtattgcctggcttctgtagagttccttctaaggcagatcacagtgggatttggaggtctgtctcttgggattatctaagacttcctagacaagagaaccctccacctccaactactggtttcttgctaggttgccatttaattaatggaatacttggttagtggggaggaacagaagaaggtcttgaaagtcgcacattcctggttcaggggaatccctggaaatgtatcatctgttttcatgacagtttcctttgttatatttatttttctcctctttcccctgtgtcttgtcagcattcatgattgcatacaatgtgcagtatcatcaagtgggttactgatgtctgatttttccctcctggctccactggatgcgtaactacaagccattttaaggagccacagtgcagcactcactcaatgagtgaccacaccaggaatgcaatgatgtgtcaacagtgatataatgatatcctttccaaatacaattgcctccttcccgtgaagaggccccatacctagaatcaactcaggactcagagtgccttgaggatccaggaccctgaggtgtgctgggatgggagtccctcctcttctttgtcttgcttatgttctctagcaagacatgggaagcaggcgctaggtaaacacactttcgatgtttgtttatggggctgaaacaaaataaactgaaacccttcatccatatataacaacaccttatggaaaacagggcaaattggattttgcccttatatcctctgagctggatcttccaggagcagtgtttgtttgttttcttctgtatgggaggtcataaatggccactgacctgtcttgttcctagtaggtttatcagtcctttgaaattattccctggcattggccaccagaatgcacctcctgggggtggagaagaaccctcttttgtgtgcacttcatctgcttccaagaagatttcagaaaagaagcttggtttgctgtgttcactgacaaaggctaggcttctagctttcctgccagggtgaggaacccctccttgctcctgccccacctctggtgtcccatccatggaatggctgctactacaggaccttccgagtattgatttctttcgaggttgctgtttagttaatggaatacgcagttagtgatgaggaagaggaaaaggtctcagaactcacattcttggtgtagggaaatctctgcagatgcatcatacattccgatgacacagtttactttgttctatattttttatactatttccactgtttgtcagcattgataattgcacagcagcagttaaggcaggagatttttaggtgatgtcattgggaaggtaaaaggtgtaaaatctaagcttggcctcgggtaaatttgaactacacagaggaactggcctgctaagggtgtggctgtgcctgccattcccaggatcacagtgaagtccttgaggcagcaggctgcactgacagcccagtagtctgaatgcctgttgctgggacacctgccacccccaggctcagaactccaagactcaaaatgtggagtttcttcatagaagttgccttaagctaaactctcagtacaaggcacctggaggaggttattaggagctgcccatcctttatggttcaataagtcaagataggcaggtctggccaggggaagggggggatatttgagtgagcggatgtgaaatacccaaatcataccctctcggcttccttctattttatacatttcctatataattcttgtttgtagagtccactgccccttatttgttttttctccttatgtcttctggtttctgtcgcactgttgactttgggtatcagccactcaaacaccttggaaagcagatatatgacccaatatagatcacccacactggtcaggatccttatgccaggcaacatttctgataacaggtttcagagaaagccctagtcccattatgtatggtttgttgtgaatggttactttgaatcaaatggggtgacctgtgaagaagacatggaacaaggctgtgaaattaggaaggccatgctgtacaggaaagaacataagtttatatttctcacttttcatgaattttaggggttgaagtactatatagagtaagactgtgtgaaataagtctgttgaacctgctacagaacttccgtttaagcaaaattgcttatacataatgcctaacttctcttacaatcacatgggtctgcataggagtttagaactggaaattagaattgtataaccaaagcttgtcattgtacaaatgaggaaacaactttggaaccaccaattaatgtctcattaaaatcatatgatttttccattccttcgctgcttaactctctatttgtaggctggtcaaaatctttctattctcagattcctgctgcattttattttattttatattttagtgtagttttttgagacggagtctcgctctgtcacccaggctgggttgcaggggcacgatctaggctcactgcaacctccacctccagggttcaagcgattctcctgcctcagcctcctgagtagctgggactacaaaagcctggctaatttttgtgtgtttgtaggagagttggggtttcaccatgttggccaggctggtcttgtactcctgaagtcaagtgatccgcctacctctgccttccaaagtgctggtattacaggcacgagccccgtgcctggcccctactgcattttcaaccttgtcaccatctctttgaaaataagcaatattctgtagacagtgattattcttagatttttctcaaatatgtccagcatttttctgcttctacaacatgtcttttatgttgaaattttccttcatcaaaatcttacttactctcttcagggcctacctcaaatgttatgtttttatacagccttccctgaacccacaactgcatacagctttcactcttttaatccctaagagctatgggtttttcctactcttatgatagaatattctgccatatgtagtcaccttgctaataggtgagatgcttttgccaactgggggaattctaattccactttaaactctctccagtgctcagattgttgcaaaaaaaagtactctcttcaaatatgcagataacatgaaattgaattcaggtctcacttatgtttaaactattttaaatacagtatgttttcaaataaaattacatgtgaattatctatatggaaccatagagtgaaaggaaattgttaaaataggaaacttttagcaatgttatttcaaatgtaaagaaatcggaggataaaatgatccaatattttatattaagtatttatgtaattaaagagttcatttcagtctatgatgaaaagtatctgtgaattaggcatttaaaatatgaactaaattaatggaatagcttttttgattttcttcttgaagataattaacaatgtctatgaccctggtaatttcatagtgataatgtgaaaaaatgcagaaataaaaatatactgtaataaaaggcaaaagtctaataaatcacaatgatgatatattatttattcatttcttctgaatgaattacgtgtcaagtagtgtaactacactaccaaaaaagatatttagtactttgtaaatttagaaaaaaaattgtaaattttcaaagcatcctttttgaaagtactcttaatcgtatagtaataatttggaaactttaatcaacaaagacattgattcctatcactatcttaggaatgttgaacagctcttttatctttaccactattaaactttgcagaggtagagcagaaaggggaggaaaaggtatttggtgcctgttatataccagatactcacaccatttattgtctgttatatctgtgatataccagatactcatccctttaatccttaacacatccctctgctgtgggtttgtttgtctaacttgcatcactgaggaattaagagagtgataaggtaagattcccaaggtcacaagtcaataagtgggagcagcaggtttgggatgaaaaaaactcttctgattgctccgttcttatgctttaactgccagcgcgggagaggagagaagacgtatggccatttcaggaggaaacaataggcaagagactgggtcagctctgaacataccaacacaccgaggatgatcagtgggccacagggactagctgtaggcacgcctcatgaacgtgttcatgcactggacacacatgttgaaccctacactttgatcactgtgcgaggtgacaggataaaaaataggtttgacactcttcctgcctttgattgatttagactagagtctagacaaaaactcaatataagcgtatgacaagacttcataagagatctgtgtgtaaaacaaaatgtgaaaatatgaatgtgtatgggaaataaataatttacagagaaactggtataaggaggcaatgctgaaactggacctggcagagtggctaggacctcacactgggaggagaggatacaaagaagaagatactataagtgaaaaacaaaacaaacataagtgtgtttgtgtctttatagtagaatgatttataatcctttgggttatagtaatgggattgttgggtcaaatggtaggtctagttctagatccttgaggaatcaccaatccaaatgcccgtcaatgatagactgggtaaataaaatgtggcacatacacaccatggaatactatgcagccataaaaaaggatgagttcatgtcctttgcaggacatcgatgaagctgtaaaccatcattctcagcaaagtaacacaagaacagaaagccaaacaccgcatgttctcactcataagtgggagttgaacaaagagaacacatggacacagggaggggaacatcacccactggggcctgttggggggtgggggtctaggggaggaatagcattaggaaaaatatctaatgtagatcgcaggttgataggtgcagaaaaccatcatggcacgtgtctacctatgtcacaaacctgcacattctacacatgtaccctcacaacttaaagtataataataataaaaaaggtttatttgtgtgatgacttgtggaaggaaaacaaatagcctgaaggtattataaggtgaacactcttgtattcattttattttcctacttgttgtgggtcttattttcctgtttcttttcatgcctggtaatttttgcttagatgcgagatatcacacattttaccttgttaagtgctggatatttttgcatttctctaaataaagttttgtgctttgttctgttacacagttaaattacttgcaaagggttggatttttttgaacatgtaatgtttgttgggtaaaaccaacgaagtcttttgtttactactcatttttttcattgttgaggtggtactttgagtacttaacccaatactcctattttatgatatttttccactctgcctgtaaaaatccaaacattggccttgtgcaagctctgaagatgactccctactgctttccggtggatctttctgtagcctgagctcagccttgggtacctctgttacctgcataatatacaggtgagctctcagctgaagaccccgagggtcctctacacatctcttgtgaagctctcttctctctctggtattttgcccggcaactctagcagcctttggccccccggcaagtctcagttctttttcctctaatccaagaactgccaaattctgcttggattgcttcccttctctgttccctggcctctctttccaggcagtgaactgggtaagtaattcacccttttgttttcttctctcaggaatcaccactctgtatttcctgttattcaacagccaacaattaatgtttcctttatttctgtgactttgtttgtttgtttgtttattttctgctctgagagtaaatctggtccctgctatcctagcaaagccttaagaaggagtagctattatttggattttggaaagaagtgtaggtatattggttagggctcacgtatcgattatgggccccagaggctcagtatttcaaagaaacattcagcaaaaggaaaggaggaaaatcataatatgctaagactttttaattcatttagaagaaactgtttaaaagcaaggaaaggacattactaagataaattgaaggaaagcaaaagggaaaaatgactgtcaggatttagggtcacttttcatcaaaatctgtaattggaattactgggggaaattgactaacagtttaaattttcaggtattttcccaattttgatttaatctgcttttaaaatcctccttactttgttactatgtgcatgtatatgtgaggactactaatgaagtaaaagatgtttatttggtcaaacaaggagtttgtaccttcaagccgctttgttagacttaaggcctcaagctgtttaatatgaagatgatagattgtcattattgtgctttcattttgtttttaataaagagagtaaaattaaaaacccacttctgactaaagtttcagaaagtacgttcatttaggacagatctctgatgttatctatcttgtaagatgctttatgatttatgggaggatgttagctttcaaatagtttaaaattaacttgcttgtaaatacaatgccaatatatggtatctattggttgatctgtacaaccagtacagagagtggcttttttttttttttgagattttaaaataatattaagcctttgagttaaaaatcagtgatatcaaaaacaatcagtgacgtcttaaatttagaaggtgtgtcacttttaattactaattcaataagggtaaacatttcaatcaacatgttttttattctttttagtgtaaaagctcttgttaacgtaactttattaatcagtacttactcaagttttctcgccagttgagtaggtcctgaatgcaagctttgtttcattacttgctaatgaccttttaactcaatgtaattttcacaatattactctttctcacacacacagaaactaaaatgcgcaaatagagatgtgtacgagagtgtgcacatgtgtgcataaaaagagagaggagggatggatgacctaatggtaaagattttagattttgtctgcaaagattagaaagtaaaaactttaattaaggaaaaatgttaccaagtgtcatttctttctacagtgacaaaaaagttctaatagttgtaataattatcattcacatgtaaacccatagaaggatagtaacaatattagaatgttcatattatttcataaataacaatgtagttgcataaaattttggaatgggtacagctttacagacaggctaaactaaatgtcacacttacgtgagaaaaaacgaacgcacaattttatatattgctaatagaattactcctggattctaattgtatatccaaatatttattcaataactattataaaataccaaataccttaaattcggaacggcaacatattacatcattcttgacattttgttctcctttccaacacatctgaaagacagaacatattttcatcctgccaaaattcggtttaacttggtcaaaaatacattaaacaaataattactgaatgcctacaatgtatcaggcactttactatataaaagaaaacttctggggcagtgtggaagtaacctaaatggtacagacatgtactcagctgagctatcgcttctcttttatgttacctcacttctaagtctataaagaactattgatttaaacttcctgcttgtcagtaaataaaattgtctctctctctctctctttctctctctctcccctctctcctctctctctcttgagtactgacacttaacttggacactttaaatctatctctggaaaatgaagaaacagccaagaaaagtcacttaccttagcaggcatagtgattgtgcatgtacatgccttacactggcagcgtatagacatctgttacattatatgacaacagagatacactaactggttttgtaaccatttgagttttacagcagggtagaatgaaagagccacagcttataacacagacgtgggagtctaatttcactgcaccccacgttagcaagcaggaaatttatacaaatcacaccagtgctttcagctttcttttaaaatcatacatagtaaaaaaaagaaaaattccctgcctaccttaccagattgttatgtaaataaaatataacccattgagctgctttataaactgtaaaactttacaagggatttggggattattattcaaccttagatgatgatgatgtgcttggccagttggaaacctcttgcctgtgataaacactagtagctgattaattccacagggcttgtatgttttcagtgccgtttacaagtgtagttttttgccccaacagtgtattggcatgctcaataagagtcgattgtatttactcttgagttttcgtatgaatctgacatgtggcatattttcattcagtacctggcttttctattcctttgaagattcccccaccccaagatttggagtataaccacaaaacatcactaatagaagcagctaccaattattttgcgtttaccgagtgctgactttgagggaagcacaatatagatttacttctggatttgaaaagggttttgggggcgttcgaccactttcttatttaactatcgttctgaaaatcccattattttgaaacacataaaggaagccccccccttagtttgcatttgagtccttcatcttgacacagtgtaccccattgtcgttcaccttctgtcacgggtgtctctgatgtctacaccaagtcttaggactcgatggaatattagtggaaagttattaattatatataattattttaccagaaatctattatggaataatagttctatttgtataggttggtgcaaaaatcgttgaggttttcagcatcgaaagtaatggcgaaaaccacagttatttcacatcaacctaatatatgaagaaattgtcttggtaagtccaagaattaacagaggtctgtggcagcccagagtataagaccataacctaagaaaccgcttggaataaaatatgcagattattttctctgcagcattccttgagatatcttacagatcacaacaaattcagattcgaggatgaaaaatcactacaaatggaagaccattagaaaatcataaaattttagaatatggggtcctgctctcttgaaatttagctaatctacataattgaaagggagtatttggattgttgaaggtttttgaatggttaagagggttaacaataatgagtggttggcttttaataacccattttattttctactcaaggattcatatatttctcagtgggatattttcaaatttcaataatgcctgaatatttaaaggaaagaaaaaagaataaaagatgacattcacaaaatttcccgttctttatttaggagttaagagaaggttatatttcattttgtacatttgagtgcatctttagctttataaaacctgtttttaaaattttactaagaagactgagaatataatatgaaacaaatttttgaaaacgcttctgaagaataaagaaaaaaagtttgaattactttatgcaaaatatgttttgaaatgaaatgaccagctagttgctttcattcagtttcttttttgcacagctcaatctatacctacaaatatgacttcaatggctattttataatcatcatatttatgctgatgtaaaccttgattctataataaaatcattttatctttggaaaccaagtttactttattcataatatctggcaaagttctggatggaagattggttctccttaagcactgtgtgatttttagttaatttctagaaatctaattttctactttattggttcactttttatttatcctttatcttgagtcaggccttggaatattttttttgcattcactgatttattttacaaatatttgctgaacatgggccactcatcccttgcttggggacatattagtgaatgaggcaggctggtacctgccacctggggctcacagtgcagcaacagcagctagaagacgctgtggaccttagggtaaaagggtctcctcgcatactgtctcagttttcataaaccctacctcactctggtcttcaagccagagctgggctttcctttgagcagaaagtgccacctctggtaggtgtggaagctgggcagaaagtgtcatctgtctccggtaggtgtggatgagggcagagaatgagtggtgctcttgcgatggtgtaagaagccctgtcctcttccctccctcgagatgcccattcaaatggtcggggcagtgggaagccaacgcagtcatgattagaagagggacctcttttctcaggctggggctgtcagtactattagccatgtgggaaggtgaaacctcctcccaccatgtagaatgtcaaccccacttttcctgtggtataatctctgtgtttttaggagcccaattatgttcttcactccaacaggaagcgttttctaacacccagcttgtcgcagctccctcctcttacaaaatcctttgcccttttcctgtggtctttattcataaatgctgaatcttttctgaggataaatcattagaagacatgggtcagatgtgtaaatgagaaaacaggatgtatgtgtgtacgtaagaacacataaaaacttgaaaggcattttgacctaacacttaactcacaaatggtaatgtaatagtacattacattgcttttgtgtgtgtgtgtgtgtgtgtgtgaaaatgtaatacaaccagtagcataagtaaaagtgattgtggactggagtttagaatcatctttagtatttcgggagaaatcccaaggcattagcaaagtccagactgcttagaaaggtattcaaggaacggatgcaattgaaattggcttatattttaaaacaccccatactgcttcctgaaatagaacacttatttctgttagtttgcctgtgaactctggccctgacagaaatatgtaggaaatgttctatggcaggtggaggcactggctgttgggctagtgaatgtattttcttcttctttaatcctatgtactttgtcgattgtaactaagagtttgtgctgttgtattccatgtggcattgtgttgtgacttaactattaacgtgactgcagtcttgaaaataatgagggaaccaaggaatgagatgcttttaagcctttagacttcggatgtgttgacagtctctgcatgtcggatacatggtggtatcagtgttgaatcccccatctccaggacacagaaagaaagcaagtttaactggaattattattattattatcattattattattattattattttgagacggattctcactttgttgcccaggctggagtgcaggggcgcagtctcggctcgctgcaacctctgcctcccaggttcaagtgactctcctgactcagcctcccaagtagctgggattacaggtgtgcaccaccatgcctagctaatttttgtatttttagtagagatgaggtttcaccatattggtcaggctagtctcgaactcctgaccttttgatccgcctgccttggcctcccaaaacgctggaattacaggtgtgagccactgtgcccggcctagttctgctttttttaagtcatatgaccttagagtaaatgtctgaaactttcagagctcctggtttccctctctaaagtgaatttacatgtgttgatgtttaaatggcatctgcatgtttaaaacagacagtccacattgacagttaattccaacattcttctttccctcccataacacgtatttcctcctgatgtgacctacgcgtgattttttttttttttttcattttgacatgtaagacctttgggagctcttcgggttcctgcattgctaacattttcagaggagaattaaatgtcacaggggtcccgtcaggcatcttcacactaaacgcattctcaaaagcagagtgtgtgtcacgcatagtgacaatgatggtctgctacccccatgatggattcctccctctctagggactcagctagctattaaccagattcttcgcattctcttcctggggcactagaggaaagtgactgaaaatttagccaactaggttttttcagggttgttaagcttttcctgttattattccctaggtttaaaaaatgtacatttagtagattagaaattaaagaccagttccagcttgctcactgtctaagggaccaataagggaccataagaatgttgtgtttctatattagctctatggctatcatgggactatattcatttgtagtttattctatagaaatttatgtgaatcattctctaaattctacctccccatcttcatttccccgcaaaacttaccttgcaggtcaaattatgggctcttcctctgggcttccaaattatttatgccaatcagtgttattgtttttgccacgtgtgatgaaagctttttgttttttaatgtttttgagatggggtttcactcttaccgccttgcctggcgcgatctcagctaactgcaacctccaccaccctggttcaagcaattatcctgcttcagcctccggagtagctgggattacaggtatctgccaccacgcctggctcattttttcgttagtagaaatggggtttcgtcaggttggccaggctggtctcaaactcctgacctcaggtgatccactcacctcggcctcccaaagtgttgggattacaggcgtgagacactgtgcctggccaacaactttaatacatctgttgctcataaatagaacgactgtgagccctttcaatttcatcattctcaataagtaacattgataataaaactggaaacatagagttctatatgtgtatatatatatatacgcgcatatatatacgtatatatatacgcatatatatatacgcgcatatatatacacgcatatatatgtatgtatatatatatatatatttgttccattaaaagtaattagcttattttggagtttaaattgcttttaaaaaagtaggtatgatcatgtgtgttaaaatacctatatgagtatacatcaatgctaaagtttgccaataaattaggattgcaatatgatcagttacgctatctatgcattctacacatgcatatagatagtgtgtatgttcattgtgtcttctgactaaatgcacgtaggaagcgtgtgtaaagataatatattttgatttttaaaaggggggtattgataacttttttaactcctggaaattgacacacattctacgtatttctttactagctagaaatgacaatgatttcaacacactataataatttcatagcaatgcatttcttttttatatgctgaataatttttattttgttttctaagtttcaggtttagggatacaagtgaaggtttgttacacaggtaaataagtgtcatgggggttcgttgcatgtattatttgatcacccaggtattatacccagtacctaacagtgatcttttccgctcctctccttcgcactctccaccatccactaagccctagtgtgtgttgttcccctctatgtgttcccctctatgaactctcataatttagattctacttttttttttttttttttgagactgagtcttgctttgttgcccaggctggagtgctgtggcacaatctcggctcactgcagcctctgcctcccaggttcaagcaattctcctgtctaagcttcccaagtagctgggactacaggcgcccacaaccacacctggctcagttttatatttttagtagagacagggtttcaccgtattggtcaggctggtctcgaactcctgatctcaggtgatctgcccaacttggccttctgaaatgctgggattacagctgtgagccacgatgtccagacttagattccactcataagtgaaacatgtatttggttttctgttcctgcattagtttgccaagaataatggcctccagctccatccatgttgctgcaaaggacttgatcgcattcctttttatggctgcatagtattccatggtgtacatgtgccacattttctttatctaatctgtcattgatggacatttaggttgattccgtgcctttgctgttgtgaacggtgctataatgaacattcacgtgcatgtgtctttatggtggaatgatttatattccactgggcttacagccagtcacggtattgctgggttgagtggcagttcagcttctagctctttgaagatatgccacattgctttccacagtagttgaactaatttacactcccaccagtggtgtataagtgttcccttttctccacatccttgccactttctattatctttgtacttttcagtagccattccgactggtaggagatagtatctcactgaggttttgatttgcatttctctaatgattagtgatactgagctttttttcatatgcttgttggccacatgtaagttttcttttgagaagaaggcatttcttttgagatagtcttgctgctgaaataagcaaaggtgagatctaatgtgaatttcttcctttggtaaggctgtatatggacacagtctccctctccatgctggagctactctctccatggtatacaatgcttgcgtgtcttgcaggttctatggttgttgtgtctttgttttgccacccctaaattttatagtctcggtcaaatgtgtctgactcatttttcctaacataccatgttgatttaacatcatcgagagctatgaaaactttcaaaaatgtaaatgtcatacaagtattgagattttattgtgtccaaagatattttatttaatgtggaagaaaagaagtttcaaattaataaacagcagataaaagataacgcatgctgttcatccttcctacttctgcacaatttatctttgttgaataccaaaatgtttaaatgactgggcatcatgtaggctgtgagaaacactgtctgtgaaccctttgaccaagatacccattcattccagtgtggaggccttttcccttccacacccacccataagaatttcagctctaagcagccatgataacagttctaacttcatatttttctgtgtgataagttaattgctaattcctgaatcctccactagatggaaaggagattaccattgtttctttatggtctgatgcaatacctgggtgttagaaacgtgaagcagttactaggagcagggatgaatgggagataagtgaatctctgagaggtgataattgcagaccttagcattcctgatacttcatctttccattaccctctgtcttctaaggcttttcataccttttagcgtgttttccaaactccttagtctggtgtgaaaataaagcactatgtaaaaataggggtaactataatcgactatcatgtttctaatgagcttcttaaatcacatttcatagttgaagcacatgtaagaccctctgaagtgatgctcagtgtctgcagagaaaatactcagacagctatatttaaaatgaagtaagggcgaagggacctatatggaggtgaggtttctatgcttcattgatctagtaaaacgttaatatcaatagactgtgataggttattttgtatgtgttgtgtatgttacaatccctagagtaaaatctaaaaaaatgtgtaaggtgatatgctcaaatacggtctaatttcagtagcagtatgccccttcccaagggagttgtactaaaatgggagtgctattagggaatttcatatgaactgagagtttggctgcttgatgtgagcctatgatttatactttgtctgtgttacaggatttaccttttagtttagaaatttgatgagagaaaatgcatttaatatttattttttctcgtctttcataatattaaaattataaaaattttgaatttaatttctttcaaatttccaaagcttttgagggtcttctctaagggactacagaacaaaagattagtttttttcctaaaaaaacttctcatctcattttataaaataacatgctaaatagacagtgcaattatattgtatctgaagaagctgaataattagttggtgtgaattaattaaaattatgggtcttgcacttaacggtaatatcaaactgaccctaggaattgaaagtaaccttcagaatctccacacatcttcagaaagttgttgaattggcctgtgtgtgcaaagtacaccctgacattgattaaactagatagaacaagtgactacaaaaataacctaacataaaaaataataaaaagtaatataggtgtgaagaatgacatcaataatcatttgctgttatgcattttctcacctagttttaggaattagttcaacattatgtcagaaggttacagggagtatttgagagtctttaaaaaaggagaaataaatggacctttgatattttctgagtattttaaaccatgtgtttatagctataatataatcattacatgcctttgatatggggtgtcattgcttcataaatgaaggaaacaatagcataataactcatctgtgaattagttttgtaaataatctttagtcatcacgctcaaacagccagtcttacacatctcagataaattactctaaatcatgcaaatgcaattaaactccaaaagcacccagatatttgcgtaaagcctcttataaactgttcttggaataagaatccttagttttccaaagcaggcttaacaaattctctccattattctaaggagcatttcctgtaagagcacaggaagatatatcgaagacaacgtccaactctgctaaacacagcagggtctctgaagtactgaaatggccttttgccgtgtttcacattggccctcgctgaagatcacatccttttctaaaccttttttcccatcatcagactttccacataacacacacacacatgcacgaatacaccacagactgtgcacagaacacacactacacacagtgcacacgcaccacaaacgatacacaccagatacaccaccccacacatacacttcaaacttcacacacaccatcaactatacacaacagacacacacacacataaaaaaaactatacatgactgcataccacacacatcccacacagtctcaagtgacttcacctcctaactcacagagatattgaggaacattcgaagaaacgctcttgtttctctaagtaaaacacatcttcctgctttgccaccctctccacttctgccactgttcgaataaagaccaaagtgtgtaactgaggctgaaagtcagatccatgtctggcgttgctctgtagtatgcccaccatcactgtttacatcccagcctccttgagcctctgtaatttcttcaggtgtgtctctcctctgttacaccgaagacccttgcatccgggggtcctcttgctaaaaacgtgcctctgctgcctcctctctactgaacacttcttgctcagtgaagatttctgttgagtttcaccacagttaaatcatcatattataatttttcagactgtagtgtagagaggtaaactgactctggaccttattccacccttgataaactctctggttgcccatgtaggtattcattcccactcatggtcaagagcatcgtgctgttcgtttgcaaagtcaccaacaaatttgtattttaacccatttcccatcgtccttgagatgcaaaattcgataagcttgcttatttcacaagttgggtgggtacagaggctggactctgtaaacacagataagcagaggcaacattttaaaatatgctattacttgaacagaccaggcatggttgacataacagggtagtgaagttttatttcctgttaatatccttgggggatgtaacatgggctttcagaagttgatgatagcatctcaacttggtgtgatacgagaattgtggtggagaaaagagtgcaggaggccaagctgtgctccaccacctctcccattgctctgactcattttcagcctcaatgtggacatgtgtgatgcctgtgctaggggattaatatatatatgtgagagatatcaacagccctctgtgcatgattagcatatgttagactcacaaatgagctgtattataaaaataatgagccgtagaagggggttgatacagtattaaatggagcctgtgctgaagatgagaagtagaaatgggaactcagtacagagacaaggaggcagccggccttgtagagataaaacaattgaaattggcaatagtgggagcagggttgtgatgaggataccataaaccccacagtggacatggtgcaggcgacgaagaggggctgaaccagggcggtgacagatgggaaaagacagtcgatctgagagatgcttgggggtaggatcgacagatactgaatcccacactgaggattttgaagtatatttttagcgtaaggaaagcataactgcagattttgcaaaaagagattgaaaaattattagattttttttaaatctggagatgttagggattgattggtgctatggagaatggaagaaagaagggctgatctgtggactcgcaccagaacactaccctgctgcggtcgggcactcatttagaggtgctgctcactatatgaggacgttttggaagaggagagcatgtgaattgtacaatcacctacatgtgatcgacaatggatacatccagatgtgtgaatgagattgaagaggccaagaaggaaagcatcaggatgcttaatacaccatgggcagggagctgtttttttgcataaggaagaaaattttgtcttcaagatgagcagtggatatcagtggttctagaaatgagatcttacaccctgctgaggcattcacaatatggaggtgataaaatattttttatcaattgaactttcacgatgatactgtatttttttgttctgtaggttttttaatccagcattatcagagtgaggctcattgattagtcacataaaggagtaaaaatggtgatgatggaaggatcgagctgggctgttatatattatttagtgtctattcaggaagggccattctacaacttgtgccaccacgtattgttagtgtcgtgatattttggaagaacttttctgaagagcacactagcgttttaatgcagacaacttcagcgtgttttaaaccagtactctttcttctaaaaatctacacagactattcattaccaactatttaaaaagcaaaagaagattcattataacatttctcacaatcataaatcaaaatgtccagtaatgtgcatacttaatataattacagcaaatgcaccgagtataatattgcacaaccattaaggtaatgtctgggcacactatgtatcagtatgaaagttaccctgcaatacagtttattaaataaaggttatagaatggtaaacattctgatgcttgagaacaattgcatatacacacgtaagcaaagactggaaggggatccatacaagatcggcaagttacagtatgagaggttgttttcctgcttttgaaatcccaaatcacttttgtgaagtgaaatttaaaatacagatcagtagtgtctacggctggtgtggcatctgtacatgcaagagatcattccatctttgcaggaggacacattttgagcaagcacttactctctgctggttgaggatgttatgcctttttgagtccttcagctaaaacggtcttacgtggattctgtattgaaaggttaattttttactctttttcattctttcctgttattccagagagaacagcaatactgggaagttgttctgtgacaccgctctgccctcagggaaagcagtgcctgtaaaagcacattaattttacagtgattccagctgctcagtggcttaccttacttttagtcgattatccctttcacttaagctgatggaaccctcagcaaatctcttgctctatccctgcaagccccttagattccagttcgggtctcacttctcttgctgcctggctttgtggcggcctgactctctcctagcgggaggctgatgcagctcagttcccaggcattggaaatggccgatttagctaagcctcaaagtttgctggcacttcatccttctctgttggggagtgtgtttgtgaagttacttgatgtaattgggttaaaaactatctttcaaaatagataccaatgcatgtatccgcaatattatttttgaaattttatccaggaggcatggaacctgttgtgattctgtgccctaaaacgaataggtgcctgtgttgaaaagggactctaacgtggggaactgtgtgtttgtagtgggtcctgtaagaacaggcattggcattaccatccagacgttagtgtagcaaataccacagcctgataaaagagtacttgttcatcatctcatcgttacaccttaatatatattttgatagattaagagtatattttgtgaaatgattaaggtgaaatagggtctcaagacaaaagttcagtggttttctgaatgacctgcaccaaggtatggcttaggatgaagttactaatttattgtaatgtatatttattttttggtcttttcttttaccaagtgatttagttggctctccttgtagggaggggcatcatcttcaaactggagatgtttccttgctgataggtgcattatttgggtatgagtagcagtgaggggaatctgatctgtataaaatgaggaaatattaaagaggatttgacatttcaaagcaattttaaacacatcccaattgattatcacgatgagctagcaggtggcccagtcctgacactgaaacagtaaggcttacgtttgtgtcaggatgggactctgtactatctgggtgacttccagcaagtcacttaacttttggaacttaaattcaccttctgtcgctcttagatggtaataatttctctatttacaacatgagctcactttgataatcaaatggaatgtatctaagacatcagtttgacatacaaaataaatatcttctatatattctatattgaacatgttacccgttaataaaatataaaatccttgactttgcctgcaaagcccttcacatttagaataaaacagctttaaatctcttttcatcaaaactggcttattctcccaaatttgaattggtttatgtccttctaattgttttatttgaaaattcaaatagtagcctaaataacagtggttaattttataagacaacacaatggtatttcaagggtttcatcgaggctttgtgatcccctggttctctcatcactgctttcttggttcttttatggacgcttcctagacatcatgttcaggttctaggcaggaggaggcaaaaggaagagggaaaagtggcagctggagcttatcctttctttagaaaagtactgagaggctgaggcaggcagatcacaaggtcaggagttcgagaccagcctgggcaacatagtgaaaccctgtctctactaaaaactacaacaattagccggggagagtggagtgtgcctgtagtcccagctactcaggaggctgaggcaggagaatcgcttgaaaccaggaggctgaggttggggtgagccaagataatgacagtgagctccagtctgggcaagagagcaagactacatctcaaaaaaataaataaaaaataaaaaagtgaaaaacttcccagtcacctctggtagaactctcttcatatgacaatgtccagaaggtgccacacagtcaccaacgctgctgagaagaaattttttaaaatttattttccttttacagaatctttgaatatagacgtgctagagatggtaaggagattgaaaatcaacatgagctcagcacagagaactcaaaaaaaaaaaaaaaaaaaaaaaaaaaaaaaaaacagcttcctgcccaatatataaatgagacaatgaataaaaaattaataaattatttgaagattttggtgatggaagatgctaatttttgcttcctttaatacatttgtcagtgccaggttataactaagtaaaaataattatttttgttttgttttcttttatatttcatgagagtagagaatacttatctgaaatagatgatgcctctgttaacagatgttattctcagttgcaagcccacaatattcatgccctattatatgtttgagggaagttttagttcctagagaaaatcataatgtccttattttaattccttttaaattactcaaaaattgtctgtgtaaaatcatttttatacctacttccttgtatgtgttttccctaaacacaaaagtgccattcctgattttcttggattttgtgtctatttgatatacagagggctgaacttctggtcacagtttcatgcataaagggaagcagcattttccagaaaaaaaaaatctgtcttttgagttaatatgaatcagcatggaggccaacatttaaactgctggtcctgcctgctagtcctggaaaacacagggtcactaggaccctgtgacttcactctctggcttgtagaggggctgacggtgccaactctacctggactcagttggggtcagtaaaaaactaaatgacttaatgagaagaaaagagtgttgaaaacacggcacatacacaccagtttagtagagatgaatgcttttgaacattaatcagctattagttttgacctttgtgtcagagaaaaacacaacaacataggagagaatccccttacggtgcattatcgtatagggttgagagagaggcggaaacctgactttcaagacggtctcttaatctgacttcctacatgcaagcacgctactgtggtcaagtagcttacattttcacagactgctgttttgtctgcacgatatgtgtgataaaaccaccttcactatgggatgaaagtaatcacatatataaaggttttcaactagtgcctgaatagtataaccccttgatacattatcactatgaatcactattattgttattatttttacagttattagctaatgagttaaggaaaaccattccaaggatatctcttacctattttcccagaccatcacctaaaacactacatttttcttttgggccttcattgcatctatttaaagctttgttttttattaggtacccctcaagttccacctggcaattggccttaagtccataaactgtttttttgttagcaagatagcttgcttctacataatgaacatgatgaactatacaaggggtcttcataaagtttgtggaaaattctaatgaaaaaattagggatttcaaaaaatatttgtaccaaaataaactcatattaacttgttctaacatatctgaacaggatctagtttgaggcactaagaaggataaggcattagtttgaaaagagcccctatcaaagcaacataaattctaataaacttgaagtgagaacaacaaatttatggtgaagcttgggcagaagaatggtgaaatcaccgatgctttctgaaaagtttatggggacaatgaacccccctggcaaaatcaagagtttacaattagataactaggtttaaggaggcaggacatgatagtgaagatgaaacccacagcaacagactatgcacatcaatttgcaagaaaaataataatctggtccatgccctaattgaagaggcctgaaagttaacagcagaaaacagccagtgccacagacatgatgactggttcagcttatacaatcttgacaaaaaaataataattgagcagactttccacttggtgaattccaaaacattgcacccagatcagcttcaaacaagagtagagctttcaatagagatcttatgcaagtggcatcaagatcctggaccactctggtctctgaagagttgttacaggagataaaacatatctttcccagtaccatcctggagacacaacagaatcaaagcattggctaccaagggctggaagtggtacagtcaaagcaaaagcataacagttgagtataaaggtcatggcactggtattttgggatgctcaaggcattttgcttgttgactttgtggagggccaaagaatgatgatgttggcttattatgagattgttttgacaaactagccaaaagtttagcagaccactacccaggagagctgccccagagcgttcttttccatcacaacaatgctcctgctcattcctctcctcaaacacgggcaattttgcaagagtttcaatgggaactcattaggcatccactttacagtcctgatttggctccttctgacttctttttgtttcctaatcttatcatgctgctataaagacacatgcacacttatgtttatagtgcactatttacaatagtaaagacttggaaccaacctaaatgtccaacaacgatagtctggattaagaaaatgtggcacatatacaccatggaatactatgtagccataaaaaatgatgagttcatgtcctttgtagggacatggatgaaactggaaaccatcattctcagcaaactattgccaggacaaaaaaccaaacactgcatgttctcacccatagggaggaattgaacaaccagaacacgtggacgcaggaaggggaacatcacactccggggactgttgtggggttgggagagtgtggagagatagcattaggagatatacctaatgctaaatgacgagttaatgggtgcagcacaccagcatggcacatgtatacatatgaaacaaacccgcacgttgtgcacatgtaccctaaaacttaaagcataataataataaaatgtaaaaaaaagtctgtaaaggacatttccttcagttaataacgttaagaagactgtatttatgtagttaaattccaaggacactcagttctttagggatggactgaatgcctggcatcatcgcttacaaaagtgtcttgaggttgatggagcatatattgagaaataaagtttatatattttatttttaccttttaatattatttttccacaaactttttgaggtcccctcatatttccccatctgtgcccaagtgtaggaaaatatgttagatgcagaaagctctgtgtttacaaacgactttatacattatcaaaactgaacattacacaccttctgtgagataggcaaaaaggaaattgtctgttttgttgttgtttttatgaaagataactatgcagtcaaaagcactcagctgatgttacctaattagcaaatgggcaaatcaaatcctaaatccagatgttctgacatgtatgagaagttcttcctctcactctttgtggcctctttatacaaacttgtagatttatgctttctacaaaggacagaaattctaatagctattatcaacaaatagtatttataacttgaaaaatagtgtctgggccgggcgcagtggcttatacctgtaatcctagcagtttgggaggctgaggtgggcagatcatgaagtcaggagatcgagaccatcctggccaagaaggtgaaaacccatctgtactaaaaatacaaaaattaggcgggcgtggtggcacgtacctgtaatctcagctactcgggaggctgaggcatgacaatcgcttgaaatggggagtcaggggttgcagtgagccaagatcgccactgcatccagcctggcgacagaatgagactccatctcaaagaaagaaaagaaagatagtgtatgatatatgatatgatacaaaaatattggccaatatggggcatatttctgaatgtagactttaaattttatgagaagctagaaactgatttttctttgcaatatactcagcacttacaaggtgtctaccacatgatggctattgagtaagtatctgttgaattaaagaaccaattactagtggctttttgaaagactgtaggaatcctgaaaatcacctctctcatgttgagacgactggttatctacaatcacttcagacacttacaatatgtcaagtaaaaaccccctcttggaagtaattatttaaaaagtgcgttctctgggggtgatgggggtgaagaaaaactttatcttatccgacggttttaaatttaaatatttacagtgtcttattttattctgatgacttacattacctggcaaaagtatattttctcctataaatttcttacaacgtttcttttttgaagaaaagcacgatctgttttggcaagatcttttaatgttttctgtattctatcaccttcttccctccttatattatcataagtaagaaataggattaacaggagaatatttatttcctacagttcttttattctgctttttaaatggcaaatttaacatcagtagatctgcaaagcaacactttcattgttctattatatatgacatatatatgtattgtgtgtttatgtatttatgtgtgtatatatacatatatatgatgtaaaatttactcatttaagtctaattaaagaattataccagtatttccagaaataattttttattatactttaagttctagggtacatgtattttacaaacacattcttcaaaataaatttattcaaaagcacaaatatcactttaacattaatttcttaacatctagttggaagaaaatacttgatttagtatcagagtagcctgaagatgtaaatgaaaatgaaataacttcttagaactgtattaaaactaaattgtgatgttctataacgtttgcatatggttaacattaaatatgtgtatcaatatttgtaaatttacataaattcattgggtacaagtacaattttgctacatgtgtacattgtatataggtcaagtcagggcttttaaggtatccattactcaaataatatacattgtactcactaagtaatttcctgtatagggaattattcacaactttgtataacagtctagtgtctagtatggtattcttggattcaaagcaaatacagtaaataaaaactattacagtaaactgatgtcatggagcgtttttgaatgaaaggacaactgagaataacagtaaaggaatcaaacattattattgtaacttcttaccttttaatgtatgtgtttttagttttaattgcagaaacaggaagcaaagattggcattattttggaaacttcatttaactaaggcagattcctcaaaattatgtttttctaaacttttcttctataccatttttgaatatgtccccagtgccctgggatgttctccaggtcctttataccctgggttttcaccagagagacgctagcatgtactggtagtgatgcttgagttcaatataaaatcaatttattgaagggaaacaagcgtttgctacattttagcacctcttcaccatattcactcttcaggtaatccgtcacctagccttttattttcctttgctaataaaaacctttctgattatatacttttaaaacattcgataaattttcttgttttaaagtgcaggaccaccagcaatgtttatataatggcatattcagaaatcaaatttaattatataattcactgaaaatccttttgaaatgtatcacctctcacaggatgttggttcttaatcgttagtggtgccattgaatgatcttccaacacagaggcgatcaccgatggctccgggttaatgctaaaacagtagcagaaagtagtcaaaatccaaaccctagtgtgaacttttgaaaggtcaagttcaatttcaggctatcttagccttacaggaattttaaacatctaaaattaaaataacaacatttagcattataaattgatcatatgtgaggggtttaacagctatagaagcaaaaatggcctgaatgtaactttggttaactgaataaagtattagcttgcggacgcccagcaactgatgtctgtttttccttaataccgtttaacattcacttcttagtcaataaaaatgaattacagtacgctgaacgtctgcatcttttatcttttgttttgttttgtttttttagatttggattaaacaggttttctctcagtatcttatgtaagatacaaggctgtttcttcatatagccttggtaaatttcaagctctatatttaattatttctaaatgtttggtccccagtttctccagggatttaaaaaaatacatttctagattgtaaaagtatattcatgactattttatgtgttttatatttttatgccaattaagattaaaacgtattacacctacgatgctctagagtctccccaagctcttcaacctatctaacccatccgaccatttttattggcgtaaaaatgtagcattactctttcccagcacttcctattcctgtctttgtacttctttgcactattgtcatctgacttacaggtttttatattttcacatttgtgtaccattgtccatcactcatgcacaggaatataatctccatgagatgagcatttttaaaaaaattgggagtctaagacaagtctgggagatagcaggccctccacagatatcttcagatgaatacaataatcacattttctattcattttcaccagcataaagctattatttagaaatcattatacagtagaaatatacccaatagagtgtaagccctggagaaaaaaaaaaaaaaaaaaacccttattttcgtgttttcagggacccaagcctagggacctccacatacgagttaatagtgaatattaactaaataacaaactattataaaatatgaagtaaatgtacctgccttttgcatgtagaaatacatccatcctctgaattatgagtagtgaataatgcttaacatcagaaatagataaaccctctctttgggaaaagatattaattatttaaaatatttaaatattttacctctggccatgagtccaaatgccatgctatctcacactcttgtgataaccctttattttaaatcattattatgtttagaaataatggatgtggtcctgaaatatacatgagtttatagtgcataatccctgaactatagaatttataaccacagggacgaaataattcttcctgccttgggcacttctgaattctggtgctataaactcctccagctctaatcactgatcaaggttttaagctggacccagctggagatgagttgaggactaaggtgccaggagggagaccctgagcatagtttgaccacaccttccattttcgcttcttattgtggttttgattaagatttctctccttgcaaagagaaaaacaacagagagcacatcattttaagggctccttcagtcttttttgcaattagacagtttcatttttaagatgttgttggagataaagtctttaggtttttgtttttgtttgtttttttcaggaaaatgttctacagagtgagtctgggacatgctgtgttcctgagatgggagtaattagtgaagcaggcaatggagaaaagacaagagcattgtacttgtttgggataatggttgaagaaatctgaaatttgcataagggagaattaactttaaattttctctcaagatgtgtgtgtgtatatatatatatatatatatatatatatatatatatacacacacacatatacacacacacagatatatataattttaacacaatatataacatatataacatgtataatataacatatgtaatcttaagattatatttttatatattatgaatatatgtttatatatatataatcttaggattatatataatcttaagcccttaataagcccttaaaaagatgacatataatcttaagattatatatttataatatatgtaatatatataagattatatgtgtataagatatatttaatcttaagattatatgtgtataataagattatatgtgtataataagattatatatatcttaagattatatgtgtataataagattatataatcttaagattatatgtgtataataagatacatatataatcttaaggttatatgtgcataatcttaagattatatgtgcataatcttaagattatatagataatcttaagattatatgtgcatataatcttaagattatatagaaaatcttaagattatatgtgcatataatcttaagattatatagaaaatcttaagattatatgtgcataatcttaagattatataatcttaagattatatgtgcgtaatcttaagattatataatcttaagattatatgtgtgtaatcttaagattatatgtgtgtaatcttaagattatatgtgtgtaatcttaagattatatgtgtataatatatacatatattatatgtatatataatcttaacaccttagattgggttcagatcaggtgacttggcaaaatataagaaaaatatccttggcactttacctgaaagaagagagaataggaccacatggttacctgaggctttcgttccatacacattgacagctactaaaagggcaaagacaaagttttctggaattattttaggaaagttactaattacacatgggttgaaaagtaagcacttttttccaggtttttattttacccatgattattacaaataaatttagaaagtcatctaattacagtaagaaaaaaatagattatatgagaagagaagctaaaatagatggtcatcttagaatatttttaaaatgtaaaataccaagaaacatgaatataactttctatcaagttgttctggaatgttcagggtctgtagtccttagacctggtttctggtttcacttcattctctaacatggcaccatggacaagtgatttgtgtttgctcatctgcaaagtggaggaactcatggcattatcctgaggttaaatgaaacaacagagatcagtgatttagatcattatcattgcctgcgatgttaattgaagtgtctgataaacattagctattcaagtacaatcagaaagaacggtgacatcttgcactctctggaatactgtctctagaatcttgggtttattttgaaaaccgtcagtgcacgtattatttattaaaaggatatgaagcaccgaagcctttattcataggtgattgtttgtcacacgatctatatgctatcaattcagagatgttcagtttctcccgcattttggtgtccctgaaattggggtgtagttgctgctgatggcatcttacagtggctgctggtcggggttaatcagacgtcagtgtcattgccacattactttttccagtgacaggaatatagaacttcaacttcgcagtatttcggtgcaatagtcacttgagaaccacgcaataaagaacagaagtcctgattcttatcctaaaactttttatacacactatttggtaagttcaaaaagcaccagctttagaacttgtagaaagtgtttaaaagtgtggaaagctctacagtagacactaataggacatccctctatcaaaccttaaatctggtctcaccactgagtcaaaaactagtagaacagctttggacactgaatgttaaaatggcttagaaatgcatgttcattttgcttcaatgttccttgttttatttgtaccaaactgatataagacaaaaatatctgtgctttaatatgtctaaagcatcttttttaaagtatggaatgcaattctaagtaatgagatatgattgttattatttattggtggtttataagagactgctgtgtcttacagtcaaaatacacgattgcagtattgcttagttcatgatgagatgagctcttttattgtgcctaatttggaagataaggcacaggggtgacaagtctatttcatggttagtgttcttttaaagtaagtataaaaagaaacgcatactgagctagatatataaataataattttcacatattagtgtaattaatttttttaaaacactttttagccgtagctttggttaataatgcaggagcttaagagttgctcaataaatttagattggacttactagtaagatattaatatttgcacaagtaatttcagcatcgtcagtttctcattgtgctggccaattttcatttgctgcttcaagcttccttgttgtgtctctccacgactctgtgcccttggagtctggccttgaggacggcatcattgggctctcttcctctctctgtgccagggaggttcagtcctcagagtatactggacaaagggcaggtgcgggacaaaactgagagggcgatgctggtagccccctcctgctgtttccgcatgtgcagtgcatggttctactccagacgcagctctggtggaatagccccttctcaagccataaccacactttccctcccttgcccctctgcacctgaagaaaagagactgttcacgtcttttgcctctggagtgctttgtgggtcccttgttggtttctgttaatactatccatgaatttgcagaactaacaaattatctctttacaaaaagccttttaaattaacccattaaatattccatctctattcttagggaccctgactcttaggtaaatcttttatgtaataagatacatggttgggactactgaagattgtgtttaatattcagtttgaacaatgatgaagatactagaggcctaatattaagactataacatagaaaaaataaactgaatcattttttctaatgaatattttcatgtatagaaacatgttgatgatgcaagactgaggcacagaaaatatcaacatgtttacatgtattaatcttatagtgggttgttataaattccattcagttaaaaaattcgggcgggcacggtggctcacgcctgggctgtaatcccagcactcggggaggccaaggcaggcagattacgaggtcagcagatcgagaccattctgactaacacggtgaaattccgtctgtattaaaaacacaaaaaattagccgggcgtggtggcgggcacctgtagtcccaggtactctggaggctgaggcaggagaaaggcgtgaaccccggaggcagaggttgcagtgagcccaggtcgcgacactgcactccagcctgggcgacagagcgagactctgtctcaaaacaaaactaaacaacaacaacaacgacgacaacaaaattctttggaaagtaagaaaaagcagcatatacaaataaataagtccatcccttctgaaatctatgaccgggctcacctgggtcattttcatatttctttgttgttggtatggccagggtcttcattgttcctgttccctggtatatctccttggtgttttcattgaatgatcaagtgtccaaacctccattattaaagtaactaggtaataatggatctatgcaacaaactcactctggcgtctcaaactctgatgaaagaaattccttctggacaccaggctccctgcctgctttttcacatagggcagaaggttctgttcctgcttgatgtgaaaaacaaattgtccacctgaaaggaaacttctaatttcacatgagttaattattttgcaaaggccatatggtttacatgacatttcagaaccagatattacttgtcttatattagctcttaaaagtagctagttagcctaatattctttaacttttgtctccgcatataactgattagactgggtttatgaattttaccacccgttgaataaagaattttgtatctttctggtaggaaatgttctccatattgcggctataatttaagaaagaaacatatcacaagaaaaatgaccacagaaattaaatattacgcttcagctttaataaaatttctacactaagcaatttttttatgtgtaaatcaaaatgtactttccgaaaacaagtgaaatgtcagaatcactgggaattagtagataaaaaagaaaaatacttctctcttagttaattcaaattctaccatgctttggaggttgtattttaattatggagatttactttacatggttgtaagtataaatttgtattttgtttttatatgtaatttatcaatttaaaggaaagtattatgatcattatccctagcttttaaatatcttgacttttaatccatatttatccttttgaatattttctttattacttaatatttgcacatatcataagcatattatttttgtttttaaaattaaaataccaataatgtataattatgcaacactaaagagaatatagataatccccaaaccatattaagactcagattcctgtcatagaaacatttagaagttgtgtttgtattacacaaaataaaacaggaaattccattattattcccataatattttacactagggtacaaagaagatcttattttgacatcattacatatacatttaacaaatacaatttagggagatgaaattttgcccctctaaattttagaaagaaatgaattaaagcagttgagttgaagttgtgaactggcggaattacagagagctgacattgtaaaggatgatgagtcacaagaaacagatggatattttcattttgctttgaattattttaattacaaattgtgatttcttgaaagtaaaagcttaccaaaaaatcagacttacagaatagaaatcctaaatgaaactacagatagggagataaagttaatgaacattatcaatgtcatatgctcattattttgtagttgaagctgctacttaaacctggatcataattatgaatatacttctcacaaggaatctttcctaaatacagcatctacctgtccttggtaaattgtatgaagcatgggagacagaaaagctatgaatggcccttcttcatctttgttttcccccataactcagagaaacatcatctgtcctttttttctcatgctatgaaagatgcagtgtccctgacccttgtttaaaattgcccatagaacagcatggaagttcaaatctcatgttagagacctttctgatctgtgtttaccacttcctacgtctttgggcttctctccctccattcagatgtcatagagcattactgtgtagaaattcaaacacgaccatctgaaatttcacatctgtagacatatgtgaaaaccatgcttttcttctaacaaacatcaccctcgggcctaaacacatgggtttttgcagacacacatacaagtgtgtttcctttgactgattctttcaaaagtccacgcaactctgctttacctgggaagcatttcctcaccactccctgcctgtttgtatttgattccgtttggttttgttgcacatctgtatgccactataaaaaagaccgtgctgaatttgcagttgttggttctggttaaaccttaacagttgcagtgcacagagtgcttagcacataacacattccttaaatatacaagctgaatgaaataatgagtctcctctcaagaagaggtcaataatgattctaattactcacttgcactcagaggtaccatttgattcattcctgttttcatttcttgtttgtagcaaatacactttgaatatctactctgagccagacattagattagtttgtgaacacatggcagacaaaggtggatacctccttttaactatggtgcttccagtacggtggagatgttttattcacaatgcattacccagtagcaaaatctcagtagctgaagaaagcaaagctgaaagttttgctcatgtcttgagcacatgttactcaggaccatggacagctgctctactccgtccagcagatccccaccatcatccacggcaccatcgtcactgccagacctggacaaaatgtgatgaattctgagtgggagacacgtgtcagatctgaaagtgttacatcttgctcatactgacagtggacagaactcagtttatgtggtccaaatctggctactactggacttgatggagtcatttagagtgtttgtgcaaaaaataggagaaacacaggccctggctccctctactttaactaattgatcgatgttaatctatcttacctataagaaaagttaaatgtattttaaatgtatgggagttacgtgatagcaatctcatatataatgggtgaaattatgtaggcaaattagcctaaagaggcttccagggaaaacagttgaataacaatatgagaaatgaccgacaggtatctagaaactggtaaagagtatttgtccgataaactgttatataatatacactgtcttagaacgggtgttagaagaactgtaactagttaattcattttgtaaaatttttcttttgctgttacaccaaatataattttattttcatccatatgtgcactgtttttatgctcattatgacagtcattgcttgaacagatagcttgaaagatggtgctgtgtttttaaattatttttatgcacgtatcaccatttttacagctgccacactattagtgtaatttaatgttatatatggaatgaggactttaaaagtagttgttaagtaactaatatttactcttaaaataattcatagcatactggtatcctatattagtgctttactgacgtaatgggacttgattttgctcaatgttggctgctacgtagacctgacaggtatcagatcttagagttgggaggttgaccatctgagagatcttggaatcatagatttgcttaaaaatccactagaagactctacaacgaggttacaaatgttgaaaaggaattttattggggagggcggcagagttggtggcaacatccttcaccttgaacccagtggcaggaactccagctgcatgcgtagagctgaacttgcatccattcacttagaaggacaagtcataaggacaggatgtggtatctgctactactgggtaaacctaaaggcagagtgggattacccatagcctcatcgtcagcagtacaggagaaatggctacagcattgaattgaatttcctgagtttgtgtgaacaagcctgagatatttgtaggtcattcttgtaagatagcctctctggaatcattaaggtttgcttaagaaaattgaagggtgaagggagcccttcagggtggccccaaaaatagtaccttaggaaagggagcttactgttcccagtgggggcatgtcagaaactcatgaaggcacccagcactgccaggccctgagtggacgaatccatccactgcagtaccagtaaaaaagaaaagtgttctactctctagtgttttcttttctcagtcaaactttaatgctgcaggaacagaaagcatggctagcaaaataagtaaaactaaggctcagtaaaagtaaagaagttttatatcctccttgttttagctttctgtcttttgatggttgcagctaaaaaaggcagaagtttaactttaaatcaaaccttaattttattatcatattgtcttgggatttgctatctggagaaaagttttgcaactaaacatgaccatagatatgtgatggcttaagagcaacctgggatgtcctgagactgcccttgttttcacctaggaacaggggaggcacttctcccactaaatgcattcagtgggccacagagaggttggaggagagatagtatgagtccaactcgctcaaccgaccgggtccactttcagtggctatttgtgtgatgttgtgtaacttgctaaccctctctttcatacacttacaaagtagtagtaataataataataataataataataataccacctatgacgagactgcagccagcatttaattaaggttatgtaaagtacttaacctggtccctggaaggtaataaaagcttgcagacattagtcccccgtctttgttatctataacgataatgggaagctgcaacatgtgtggtgtaaatattaagtcttagaatgtaaagtaagtttcctgggcttgtcatttctaatattactcaatattggacgtaagaaagggtagttagaaagaaaccttctggtggaaatcatgggatgttgttccattacattgttcctctagattgtgtgctttcttaaaaagtatcattaaagtaacttctccagatgtgcttgatttatctgaaaataaagagttacacaaaaatactaattatattcaaggaatgtgagggggaatcttttagaacttgccaggaaatagaggcaagatatctaattagctatgtgagtaaaattaaactgtttagttctaaattacacagaatctgtccacatagttccacattaacagactaggtgttgaagaacccttgtttgttttgtgtgaagtagattgaaactcttttttgttctctcaagttactaagccttagtgtacaatcattctctaaatgaagtttcttatttttcaagtgaaacttagccctttttctttacttggcgtggatgtcagcctccttcagctgcctctatggaattgttattgactcctatccaataacaaaactgattcatttgaatcaactccttggccacaatggaatgaagtggcctcaagtgtaattagtgcacatctcctaataacaaacagcaacagcaactgaaagatcaacttttggttttctaggaaacattctcagccaaacaggcgatgggaaagaaaactaatatttatcaagcatcagatgctggggagtctaccgtgtgagctgcatacattctcttgtttgatttccactgtggccctacaaaatcagtatgattgctatcccctttcttggaggataaacctttcttcgaggtcaagtggtgttcccaaacctaatagatgaggctatcaggtgctggttttgggtgtcctcgtgatcatgcccatgttcttaatgatgagaccatattatctcagaagagtgtcttccttcctgtgccacaaccgtcttattaaaatgaagaggcacaatgggtaattcatattgcaaccgactaaacatactctccatgatttttctctgtctcatgttaactgaagcccttggtgaaggactgtagttttgaactaacatagaaggaaaaacgttgttttttaaaaataaaagaatgttccaaagtgacaagaacaacggcccctgaggacagatagcactaagtagaagcaagtgagacatggagagcatggcggagagacgcaatggagcttggcaagaaggaattacagagtttgcagtcgggagaaaagaaaactggagctcctcttgacttttgtttatggtaccagaaagaacgtaaaaacgttatgtgcgcatatcgttaacgtgaacggtcacataaagaataatgtgtatttctccagctgtatttcggacttagggatgtaactacaaattccactaagccaaggcagagagagctttttacaaacctgcttgctgtcagaggtaaaggtgactcactgcatacgtgtaattatagcattgcggatatatcatagccacttaaaaggtttgtgcagatggtatttaaaatacttcagttggattactttccaggctggaagagaccacaagtagattttgttcctgattaaaatagccaaggacacatgatcttctgtgaaattagagggacacctggagaagaagcagagcctgcatgtcttaacaaagctattttgacctctgaagttcctaacaggatgagaagcctgtggccctgactgttttactagttctggaaagctccattcttcctacaccactgccattcaagaaaagcaaagaccaaccatctgtgctattccatttagggcaatgctcaggaaatcaaatttcccagctgcctggtccaaaatcagcattagcgaaacctgccctcatccatggagagaaagccctgatatccgaaaacaagagatctgtcttcatcctctttatatttggaaaagcccactttttttctgtattatttcataattctgaactaatacccttgtctaggtgtttcttatgagaaatgtggttcaagattcatggccacaaattcatttccctctagaatagaaaggctgcagtttcagatgggagttctaaatgaaatataaagtaaaggactgcacatggcttcagagagtaatttgattatttaagcaagaacgaaatggcatttaaggctacagtcggcctgctgtatgatgaaaccggattgtatacaagcagtttgaattttaacacactccttgacatacaaaaacataaaattcatggagtaaaacttgtggacaaccaaaatatctgtaagttaaaaggacttttctcattagcattcataataatagcaaaactttcctacacactaggcatcattctgactattgtgttatgcttacaacagttttatggtgtggacaccattattatccccattttacaaataaaggaaccgaggcatggtgaggcgaggtgaggtgaggttactttgcccaaggtcttacaggtaattaactggtgcatcctgaaactgaattcaggaaaggaggagacagaaaagtgttttttaaactagtttttttttgtttttgtttctttgttttgttttgtttttgaacacggccacatatattgaagtttgtaaaatatgtgtggtttttggaaagagccaggcaagtggttagaagaaggctatcatctgacacatggagttaccctcctgggagtcgtagaaatccaaattttagtgttttatatctgtcaagagtgttgtggggatcctccaggagtcctgagtccacccttggagaacagttgctgtgagttttaccatctttgcctgacgagaatgtaaatattttgcttagactgcccaataaacgttggggctggcatatgcaagtgtgtcgcgcaagaacctataccatatgggaaggcatggtgcgcaaaagcaacatgtggaaacagaaagccacatggtgacggggagggaacacggagtggaggtaccctcccgcagtgtttgtctctcctgaagaacaacctttctctttttggggagggtgggtggggggggttgtagtttctctcttgtcccccaggctggagtgcattggcaggatctcggctcacggcaacctccgcctcctgggttcaagcaattcttgtgtctcagcctcgcgagcagctaacattacaggcacgtgccaccacgcccagctaatttttgtatttttagtagagatagggtttcaccatgttggccagcctagtctggaactcctgacctcaggtgatccacccttctcggcctcccaaaatgctaggattacaggtgtgagccaccatgcctagctaatttttgtatttttagtagagaccaggtttcacaatgatggccagcctggtttcgaattcctgacctcaagtgattcaccttcctcggcctcccaaagtgctacgattacaagtgtgagccaccacccctggccaaacttattgttaataatggtgtgtccagatttgcaaacattctaggatgaaaatgtatgtataagacatggagaaagacctggaggtcagcacatgaaactgttagccatgcttctggggcagagtaggattttataggtgggtaaagcggatttttttttttattctccttttggttcatgtccagaattttaatatgataaaacactcatgcattccttgaggagttaaaaagaataaaaagtgtgtgcttctcaaaaacctaagtgaatgtggaaaactgaggtgtgtctgttgggttttgtccatctctacccacatttcttgggaaagtttcgtgtccccaaggacctgggtttcctaaattacatgttgaagacttttaactatacgacatatataacttgagttctataaaatgattgtccttagttctataaaatgattggacaaaagcaaaatatattggtacaaagtgggagtaaaaatgcaagagataatttgcatttggaaatcctgtacccagatgaaaagaatgtgttcttagaattaattcacttcatggcacacatacccttttcagatggcaaagatgttcgcatttatacagggcagcagtgaaggagaactgaagctacaaatcaataaacaaaatcaaatgtcacagatggaaaatgtgcattaaaagtcttcatctaaactgtttgcaaaaggatagtggatactttaaatttagaaaaatcatattcatatataatttttaaatgttgtaaaaaagactctcaacgtaccttcacaaaaccaacaattgagtgtttttatccatgattactggtagtaatttctaaagtctgctaaaaaacaggatgttgaccttaaaaacagtctgtttctaactatcaggcattttttttaaatgaaaatataatcaaagggatacaatgcaggcagaatgactaatgtgcagtagaaatagtaagaatatatgagactgaaaagtgtagggtcagatttgacattaaaatgtttatacagcaatgaactgtggtaagttcaaccattaatgtaaaatataattatgatctttagaaaatgaacgtttgtcagattctgaatgatgcttgttgaatctgatatatacccgactccattatgaagtgtaattactataaaaagctctcaaaatactaccatttaaacatactattgctacaagtaattaaaattgttccgattataaatgagttgttaggatgctgtcacagccaactcagttcctaactggtattcaaataaataaaactgaaaaggtgaatgcatacaatatactaactacctttctccctgactgtaatcttctaagatcaattcatttaagataattttatggtgctgcatagaaaaacacattacacattagttgctttacaaacgcaaagcttagagggagataacgatgtcatactaaattaaataagcaaaaatggcaccattccgtcctctggcaataggaccttgcttggagaagaggacatccttgggatgttgatgtgctaatgagtccgagaaaatgaagaagagagccctcttgtccagtggccagaagatctgtgttatgatcttgacccttgggcgtgctccagtgttcctgagcttcatcagttctatctgtaaaatgacaggttcacatggattatattcacctttgcatgcagttgtaagattttatgtttctgtttattttcacaaaaaatcactattgatcaaaacgtgacttcagaagttattttgaaatcgtatttgagcaatattgtataactttaaagtttacataattaaaaatactcttggattaataaaagaatgttttcccttggatgctacaatgtgctacaacccagggaaagtgtttataacaaaggctaatcacatctcaagagaacatgaattcaccttgctatagttgaatgcatttgcaattggtaaacctgatcaagccctaacaggcacattcaccagcatctatgtcatcaaaacgtcacttaacctttataagcctttgccttgtcatttgcaaaacatttttttaatgcatgttaggtgtgtttatgaggcagctctagaaaatcagtgttttacaatgtaataagattaagttttaatacagttatcactttattcctttatgtattttgaaaacaagtagagacattacattgattccgtttaatgtttatacaaaaaatgacttgtatgtatatgttatcacatacagatgttactatatagaattatatgtcaagtaagaaagcccaacataaaagttaaaagctttaacttttggctatacatacttcttagattcaaaaaacagaaaaagaacagtctcatttgtcacaacattttaaaggacctttaatgtgagcttcaatgcataagatatttcagtaaaacttcagaaatttgaaacagaaggttggagtgtgccagtctcaaattgtttccttctgaagtgttaatttcatagctttagacatgataatttaaagctgttttttggtgaaaaaccactggtttatgcaaagaccttatgccgtcatcttactctgtgggcctgggaccacctgttctcgcagttactatcaggttttcatatctctaccttctattttcccataatgctgtcgagaggttattttaattccctgagatcatacttaaggtagcaaagtattttccacttttatatttccaggtccattttatttacatttgacctgaaaaccatcagtgggtcaggtgctcccgagggctgagtgccacctaggggccagcagaggcctcataccatcctggtacacctctggggcagcctctgccttggaaggtgaacacatgaagccagagagaccaaggaacagaattttaaaactcacttaattttaatacatttaaaaaccactactttattctattactgggaaactttcaagtgtgtttggaaaaaacgtggatatgtatatctacttttgcaattgcaacttccatgacaactaattaccaaaaaagtatttctaatgctgtatgtttacaggaagtagaagaaatgaagataaaagtcttataatttatacatttttgaaaattttaacatacgttcaaataatattttatatatagtaacatgtttttaaaaatatgggtactaggaaagtacaattatatttatggcttacacggtattgctatagagctgtgctcatctagacaaggttagcattttgtgagctgattcacacaagccttaaaatttatttacaaagttattatcaacataggtttaccttcaaacagtacccatttttcccagcatagctgcagtctcaagttctaacagtgttgatatgcaaatgtgggcactgtaaacaatttgcttgtatattttaatttttctgtgaaatgtggaggatatactgaaacagtgatgtatgcaagtgctcagattggtatccggtcgcacatttcggtactaaaatttaattgtcagattctagacaactgaagaaaacatgtcgtgtctattcaattattatttattagaaattattttttcagaacgtggtaacatatccactctctttcaaagcttattatatactacattataaaaacgtgctaatatcaaatactgcaatatacaaagctaactatatgcctaaagagagaaagtaacctttgattggcctatgcttgcttaagaaataggccatggtaaaatcttcttttaagcgtacttctaaataattcagaatatttacatttgaagtgtacggtgtaatgaagagagcatacaaaacagagttatttattttcaacgcgttagttaacgctcagcgttctagctatgagttcactgtgttctaggctgggaaggaagcagcagataggcccctgtgtttctgtttgaaacaccagtatcctttgatgttcttgcccctatgtacttttcttgtgatttgtatctttgcttaataaaaaatgtatagaacacaagcttttgacgcagttggcatctgcttcagattcatttttactgacagtgagctgctgcaggcaagcactcagtctttttatcatcaaaaagacataatccaacactcctggcctcctccatatcttacgtagagttttattttttttcttcattagaaatgctgcattgaaaattgcaatgaatgacaaatagaagaaaatgcacattcaaagttggctaattataagttgaacagggttaagatactcgaatgagttaccacatccaaagttaagcatttatcctttcattgagtctatttgtttagggcaataaaaccgtgtctgcagaatcagtgtattagaggatacattgctaaagttgcactaaccacactgtattgacattgagtaataaagtcagtattcctgctcatgaaaaaacgctattaaatgggctactgggacttggaatcttatccaaggacaatactgccaaaaattcacatttaatggtgattcagaatccaggaagatacttgacattctgttgagatgtccgtttgccacctgtatctgtctagtcttgtgtgtgactgtgtgtttcttcatgacttgtttgaagcagttggctttttacactaaatataagtgtttcaaaatgtggcttgcacacttgtgccatcgactgcttaattgtgtgtgtgtgttagtgtgtatactgcgtttacagagacagacgaagcttggcatggggaataatttcctttgcacgtctaaacggagatgctcagaagtttgctaatacggttggtgttttttaaaaaaaaattaggaaaatgttcaaacataaaaacagtagagtgatgtttatggaaagtaatgtgtccatagctcaactttaacaactgtcagtaaatagttataacaatatagcaatcttatttcatatatggacataatgttaatacagggaagggcaagtatttttaaatgaggcttgttactttcagagaagttatcctagcagtctccctttattacatacatactgcaattgagaatgtaatttaaagtgtttttcctataaatactccaagagccaaatttataaacacaaatgaaagcattccacataatcacacttggctctttgttcagatcttataccaagtcaaacagagatgatagtggcagcaagttacaagctggttttgttagccatttaagtggctatagactgttcggtatgttaataaaaagctacactttatgttgaattcgtagctaaaatttgagtttccattcatgaatttatttaatcattttctaaaaataggcatatgttatctaacgttttgttatatgtttagtattttagtaccttactttaatggtaaaactcacaattacttttgtgtcaacctaatattaaaatgctgctttcatgttaaaaaattatattttatatagctatagcagcatcagatgtaattgtatcatgtggctcaatatgtattcatattctgtatagctgataattttatagtttcagtttccttatgaattttaagtcacatattagccattttgtagattaccagcactaccgctgtgtttttaacctccttgaactttacactccatccattgaaaattaaactgaattttaatcactatacttcactgaacacttaccaagcttggctctattgagcactggaattatatataaattgtgaatgtagtctgaaattcaagaatagattcttctctttggtggaagttatatgagcataaggagaaagagaaccataaaggattttataaatgtagcattttaattattgtatttaaagttagggaaagggggttgggcgccgtggctcatgcttgtaatcccagcactttgggagggcaaggcggcgaatcacgaggttaggagttcaagaccagcctggccagcatggtgaaatcctgtctccactaaaaatacaaaaaaattagccggggatggtggtgggcgcctgtagtcccatctactcgggaggctgaggcaggagaatggtgtgaaccagggaggcagaccttgcagtgaaccgagattatacgactgcactccagcctgggcaacagagtgagactccgtctcagaaaaaacaaaaataaaaatacatttagggaatgggtaaggtctaattatgttaacactttaaggagtttcttaaattctgtcgcttgtgtttaaatcagtacatgatacaaacaggttgtttctgcatatccttgtgagaaagggaagtatgagacacctcatagtgaacttgctgttttcatgagtatagacatgcagctctatccatgtctataatttcaagaaaactctctagatataaaagaaaaacatggcaccaggaaacaatgagaatatgcttttttaagacggtacatttaagtatgtggtgaggaggttgactgaaagctgacggacagctattagttgatggggaaatgggggctgggtcaagccagacaccttcagattcagagatgaggcacgaaagaggagtgaaaggtcagaaatccaagggaagtcagtcccgttcccttcagtggatttttaagcttatttattcagaatacaacccaacttcataagaaattcttaaagattaacagcagtatgtatgtgtctgtgtgtatatatatatatatatatgttatctgtagatgacatataaatatgtatgtatagtgttggattaaactatggctctatatagtaagggtttatgaaggaactatttttaattggcagaaaagttacatgcaattttataaaacacacaacattgtaaaatggatagtctgatggcatcctggtaatttttttgacctttctctgaatttaaacttaacctggagtttatctttttaaaatatgtagtttgttttcatttgttggtatacgaaaacatacacaggctactttgaaatgaattccagtactctattacatattttaactatgtatttaaatgtttttaacttattttctgattaaggaaattgaacatttattgtatttctgaaaagagatttagttctcagggaaaaccactgttctatttttctttcccctgagggttttccttctacacagaaacatcaaaacacatatacatttccttttatttattaaaattgggatcccactggaactaaagacttcgtttcctgaatcaatgaccagaaggaaaataagactttgaatcactacttcacttaaaattatgtgtatcactttttttattaaatttatttttattatacttaaagttctggggtacatgtgcagaacgtgcaggtttgttacgtagttaaacatgtgccatggtggtttgctgcacccactaacccgtcatctgtattaggtatttctcctgacaggccctggtgtgtgatgttcccctccaagcgtccatgagtcctcattgttcaactcccacttatgagtgaaaacatgtggtgtttagttttctgttcttgtgatagtttgctgacaatgacggtttctagtttcatccatgtccctgcaaaggacattaactgatccttttttatggctgcatagtattccgtggtgtatatgtgccacattttttttaaaattcagtctatcgttgatgggcatttgcgttagttccaggtctttgctattgtgaacagtgctgcaataagcatatgtgtgcatgtgtctttatagcataatgatttataaccctttgggtatatacccactaatgggattgctgggtcaaatggtatttcaagttctagatccttaaggaatcgtcacactgtcttccacaacggttgaactaatttacactcccaccaacattgtaaaagcattcctatttctccacagtctctccagcatctgctgtttcctgactttttaactattcatggtttcctttttacacaaagtatcatttaaacaatcctgtttttgtgcaagttaatttattgttcatccaattataattcatgccttgtggaataacatataaaatataacaatatcactttcattagtatagatcattagtcatgccaaagttatagcattttagagtttttattctgtgactaaagtgttttgcacaggtgtgtgtaaagttatactcattgtgaatggaatcacactgagtattatcactaaaacaagctttgcaaaacgtatacaatttttgcattatttgcatttttaggaagatgtgcacatgaatttttgtatgctgaggttaaaaattacaatattaccttttatctatgccaattttaggaacactcagaagttttggaagttcaccaatgtgtaacagttacaaaagcagcacagttgtttgttttcctatcactccctctacgagatctgtgatctacacgtaaaattttaaataaaggccatagtatcatgcacacaaatcaatgtatttattctcctttgtcctttcctttaaaacattaaagatgattcctttaatcttggcactgagtttcttccaacaaatacacaacacagaagctttataccttctgaccttacagtttctgttcttaataaaacataaaagagaagtcatattgctttcatttcgcccatatttatttgtaaaaaaatcaataaaaacaaactagacaataatttatcttaaaaactagaaagaaaaaaccccagaaaatgtaactatgccgtaaaagctactcttttattgactatcattggttatctttataaggccaagggctttcatttgtttttcttatatcactaatctcattgttagaagaatttcttggagcaagtagtttaagggataccaatggaaaaatgtattaactatttatacctgtcattctataccacacactctgctcagctacaagcatgtttgttgatggctctcaagaaaatatgaatgtggccaagacacaacatttccttctggaatatctgtgagcaaaccttttgggtacttgagtctgggaaaaaataaaagcagtacaatagttttcaaagcaaagcagtcataaattttgttgagggtggcaatatttttccaagtgataaaaaattctaataatcccgtatctcctgatcacaaggcagtttagacacaagaaatgctatgtattatgttgactttgcacctgatgcacttctaagaaacatttaattttattttaagtaaatttaatggagacctatagatttttgttcgatatttaatagaaatttcatagattaatctattaatagaatagatataatttaaagaacagaaggccttccctataaacacagacctcttactataatttgtggactaaacaaatattaaagaaacagttatttgcttggatgtttcaattaatgccattacgactgtgctgacgattaatcaataatgcgtttgcaactcttgggcaccagagacattttgagcacgttgatagtgtttaaaatcttaattttgtgctcatagtttagaaaagtgaaacgtaaaaaaagtcatgtgtttttcctccccacgtatgccagttgggtgatacttcacgttataagcctgatagtagcagctagaagaagtatagtgttaataaaatgctgattatttcagaggcctggactttataaactattttcttctctggttctgctttgatgtctaatttaactttgcaaaaaaatacattagtgagtattagagtcacttctaagataatggaggaggggttatttaatatgttccatatagtaaatgagttatatattacaataaagtcacagtttcttacttcaactctgcatttattttaagtgacatagaatatgctgaaaaaatgcatgcggttatcactgatagcaatacaaatgtcgttctgaatactcccaggacacttcaacagcctccatagaaaagtaatccagtgataatggtgagagtcaacacttactgaacacttaacaccatgttaagcacagcaagtatgttatatcatttcaccttcacaaccatttggagaagtgaccagtacaggtttcaccagacatacacgcagacagaagcttacagaggctaaatcatcttgctgagctgtcagtgttttgacccagatggtctagctacaaatccttttaactgaatattcgaataccatatccaggttataaactatttgctacagattactgctctctattagagtttctagataaaatacagaaaacctcatttaatttgaatttcaaatgaacgacaaatgataaatatttatattaaaatatattcattgcttaactgaaaattgaagttaatagaatgtcctctattcttatttgctacttaactctcaaaataagtttattaggcatttattataatttgcttctgaaaccccagagttgaagataaaaaagtataattgacctgagcagggttgcaccggttatctgatatgaaatccagaaacccatccatttctcgaattacccgtaaatatgaatggaatagcactttcatgacttttgacataaaactggaaaaattatatacatatactcacattcatttgtgaactaatacaaatatgctcattgcctttttataagttatattttatgagaaagactgtcattcaagtgtatattcttcttacaaatgagttatccaaatctcttttaaaagataaaggtaagagtaaatggtaattttccctctatcatttggctctttggctttcatttgtttatattttttatacttcttcctcaaaaatcaaatgatggcaacataatgatccccatttttaaatgataatagttagaaatgtcaggtacatgacgcaatagctgttttaagcatgtggttttccttcctttgtaattaaaaatattgtgaactaatttcctttcttacaaaatacttcttatttgatttctatgagaagctaaagctacaacttaacaaattttatctatcgttttatctgtgtgtcgagacttattcatcaagactgatacaagcaaaggtatatagtggtgagttagagtaaaggtcatctcatactaacctcctttactgagagttcattcaagaattacagaatgaaaaatgtacagtcaagaattacagaatgaaaatgtacagtcttccaaatatattttatgttcatctacagtcggtttggagtgttaggaagaatgcaattatttctcacctaattcaacaaaaacaggcacataaaagccctgccttcaaaaaaggtatactgcaagtaaataactggtattacaagtttgaagcaaatcacttgttatgcatgtggtttctatgtattttttgaaatactgtgatcgtgtatagttatctgtgcctatatactcatagaatcctggttttagatagtttttcctatgtagtatgatatatgtaatcctcattgtctataggtcttggaaactgagacttcaggtgaaaggatgtacagcaattagtggaataacatgcttttgttcaatgtagttttgttatgacattggcaaggaaaaaaatgtttttctatttataagttttcttaaagtcccagattcgaagaacctattaagggcataaagtactatagtactaagccataaagtactatacctattaaggtcatacaggaaaactagctgtaccagcatgctgagattaatctagtaagactccatgtgtccagccacacacacacacccctgacaggtgtgggtgtacagttgatagttgaacagtgcaggtttgaactacacaggtctacttacatgcaatttttttcaaccaaacatggatggaaaatagagtattcacggggatgtgaaatccatctatatagggagggctgactttgcccatacatgagatctgtagggcaggtattttgctatgtatggggatcctcgaaccaatcccctgtggacaccaagggaggactgtatgcatcgtggaatgcactgtgcctttcaaatagcgctgccaggaccaagtaatcacatgtaagcttgcagctggaggagtaattcataatgtggaagctgcatccatttttgttttatatgtataagtatattaatcatatacaggcctgggatttagtagtgagttaggattaatatacatatagtgatgtataccttaaagtggatgtattttaccatttcttttcttttcctttctttaaagctgctgcaaaagagctaattctcaggcacctgagattttctttgccttttttttttctctcttttgaaatgtaattgtaatggtggtattttgttggtggtgttcattttagatctcctgattttgatgcagttttttctctatgaaaaatgtattgcattgcagtgagtttttcttcagttaatgaggagagtctcctacaacatttcaaacagggcatcaggcaaagctacgtattttttaaacttttatttatttattttgacattttccaagcactgccagtgtttcttactaatgaacgatttcaccaacctctgtgggttgatggttgcctgctgttagggcaccaacccctacagcttcatggtcctgagtgtccactacgccctgattcgtgtatatcgcattgcaagtatatatatgtttacatctatccataaatgaaaacatatgtaatgcaaatgatatctgtagtgacaataattcagagtaagctccaggcagaatgaggaaataataaaaggagtggactttgaaagcttcaacattctgaactttctgcaccagctcttctaggaaatctttctttaactctcttcccactaggacctgctctcataacaatttaaaatgcaatctcagtaaagagtgaacgcggtgacagtttaaagtgctccctctctctctaggggtgtctcatttttcacagcgatcagcaccttgagttgtttgttgaaggaatgaggtcctcagagggggatttcaagcatcagtgagtaagtggggaagtcacggagtgtggtgggcggcagggaactttctaggaggaaggaagccacagccccctggggggtgccgtgcaggtgatgagtagcactgtcctcaaacacaatatttctattttcacattacaaatgaaaataaggatcagacggttttagtagaagaaaggagctacattggcagacacgcgatcttcatttgaggggcaggtttaattctatcagagtcaaaatcaggttgaacaggaagtcgggctataaaatgtgtagtcatcaaacataatggggttcaagctgtactagtcacagctggatatcagaagagaggagactcagaaaagcctggagatatgccacatggggagaagaaaagctctgcggcttctctgtgatctttgaaaatagatggtttcagaaagtagaagagccaaggcaagtgtggccgagggagatcatggatggagacgaaggagaacaggagatgaagtggaaacagagtgtgaatcgtggtttgttaataaagcataaaaccagtataaagactgggaagaaggtaactgtagtgaattaattaaaaatgagaactatttgtaagagacatgagaaagaaatgcctggtgtgatttgcaccgtaggaaacacgcggctatgtcaactcctttctaaccgcttgcctccttcaagtctctcgtccacattccagcctccctatcacaaccaaagtctcagaaagagattgctgaaatattgatctgatcatgtttctctcctcagaagcttttcaatatttcatcattaatcataaaacaacaatacactgcagagttgaagctcatcttatatatggccccaagctcaggtcaacattttgctgtgcctcagagaggtcgtggtttcccccaactgttggcttgaacgcccttcttcctccatctgtaatggaattctgtaatataaactccagtaatgatgcaataacttcaagacattttgtaggggaaggatagattggcactacttgtaattctgagacttcattgggtatcacctgtatataattttcatgcttttttatgaagatgtaattttgcagtgttttaagtagaatgtaaatattaagaattcaacagatgctggttaattgataaactgcaaagaaacaaaaaattttattttggatcaggcaacctgataaagtcatgtgtgatatttacaatatacgtataaaaaatgaggttaaactgtatgtgaaggatgctttcaaaagattggagaaaaaggaaaaaagctaccagatgaatgcgatatattgagggcttttagttagataaaaacatgcttcccatattcaaaaaagtcaaagaatacatgagctctgataaaaatacttgattaaacttcagagagaaaattctcaatatcaaaagctacacagccttaggagtgtggttcaaagcacaatgaagatgaaaatggagccaggcacagtggctcacacctgtaatcccagcactttgggggaggccagtgcgggtggatcacctgagatcaagagttggaggttcaagaccagcctgggcaacatggtgaaacctcatctctgctaaatatacaaaaattagccgggtgtggtggctcgggtctgtagtcccagctactaggagggctgaggcaggaccatggtttaaacccaggagacagagatttcagtgagccaagatcacaccactgcactccagcctgggcgacaaagtgagactccgtctcaaaaacaaaaacaacaaaaagacgaagatgataccttggaaaatgcacctcattgtgtattttactttgcaatcaggaaattaagaaaatgtttcatatattgaaaaaataaaaggatacagcagaatgagaaagtaattgtaattctccaaatagcaagcatcttgatgagtatatgatgcattatgaataaacattctatgtggaaagggatttgttttatgaaaatctctcccatattaagattacttgggggctattaaccattttataatgtcctttgtgatgtcgatgttattcagatatttgtgggttttttttttagcaatttaatagaattaagtgggggtatttggttatgttacttcaaaaaaaattgagatacacatatatcttccttattttgtatgtacttggaatttacagagatttttaggttttctgtgaacttgactgtaatcccatagctactcttgcaaaaataagtctttggaaatgaggatattcatctctaatctttcaagtaagtgaaataaaatttaaaaaatcattttgactactacttgtttctctaaatactacaaaatacttagaaacgtaagcagcgatactacctttcagtacctcagacttgctgtgagctataaacaacaattggtcactgctacaataattacttcctcttgagagaattaactaagtgtattgatccaagaggaaaacattagtcaaaaagaatctaattaatattcaggtcataatggttttatatgtagctgtagtcatcattttgttcaaatatagaaactcaattagtatttgaatgccatcttttgctcaccttacaattattttctttaaacaggatgataatcctttatggtgagttgatacagagtccaaattaagttgttgtgaaaatacattttggatttggacatatgtttaacagtgtcaatattcttggattaggttttttgtaacaatgtttcaatttgtggattgcgaggattttgaaattgtgaacacacttttcaagaatgacctcgtatatatgtcttattcctatctgctcccctccaccatctcacttgtactgactctagaaaatagatccaaaaatgtagtttgaatatatatgaggcatgaataagtgagtcctattttatttcagtcattacagtgtttaaaaaaaatttaatcacaagtatatggctatgacaataattcaagctaaattatatacactttatattttgcacacctgcaatgtaccttttcataccattgttcaatataaaatatgcattctgatgctaagagtggcaccttacaatttggaatatcttcagaactttggtgaggatgtaaagtcatgtaagacactaaggagggagtgaagccaaagcctaaacacgaagtatgcaaagatatgtatttaattattaatatttaatataaatgtccatttttttctaccaaccaagaatgtgtcacttattgtgtcagtgaccattgctatttctattacaattggagttgcagtgtagctgggatcaatacttactgcgtttagatatgaagactttaatattaatattcatttatattcattatatattatttaaactatttttactctgctgtagaagcttatcattttcttcacatagatctttcagagttcatagttaatcctaagactcccttttaaactcttattgttactttttcatcctaattgctattttataatttttaaattatattttctaaatggttatagctaatacatattaaaacatgatatattttctaagtagcaacttcattgaactcacttttctttaataactgttgttaatggattcttttgttgtgcattttttggaattaatgaatattatcttcactgtttcaaataattatacttatttaattctcccaactaattgcattagaaagcactttcaaaaaaaaataacattgaagtaaacagacactctattcttgtctctttaacaggaatggtttctgttacattactaggttttatgcttttgttttgtaaaaatcacaaaagtgatttttatcttcttaagttccaaaattgttaattttattcaataatagatattttactaaatgtcatttggtttttattaatcagtttgtttcttcttccatcttaacacgttgaattaatatgttttcaaatattgaatcatatttttatttttgcagtaaatgaaaagtcatcacaatccactatttaagttttcatctagattctctgtgctactattttgaggatttatagatcatcaaatttttattagacaaaaaattagaatttttgtataatgtataaaactaagtataattctttgataatgtatttttcaagttatatcaatgttcatagatgacaaataaaaatgttcaactgcaggacaggtcactttacgccattagtggggacatacctgtatggtgtacttgtttaaaattgtttttctgaaggaaggatatgaggcatgagtatgaaattgttctactttttaaaatttagtgaatactttgacagagttataaattttatccttggcttctatctaaccaatcatcaatataacctaacatattataatgaaatcacattattacacataaaatgaactatattaatattttcaaatatattcttgaaaatattaaaaagttgtgtttgtttttctccaaaatcaactgtttctaagacctggacagtttctcttacatagaaaacaaaaatttataaaattttctttggtattaaatttttaaatgagttgtatggaaatgtgttaccattccacttagaaaaaataacgtaaaaaacctccaacttggtgaataacactgggtttttggtggtagatgagtagctgaagtaaaaaggtggttttaagtcagttccaaatgatcaatatcagctaatatgcctggtgagtctatgtgcggtgggcaggtgatcagtatcagctaatatgccgggcgagcctgagtgcggtgggccggtttgggatgacttacacagcccaaacgcacacaaagtaggcatggaatacagtgggggccatggttccccgtctcctgggcaatggggggaaatctatttcttcacattttattttggatttgtgtgggaatctttatctgtggggacaccatggacctatagaaatagctggcttttagggtaaccaagttgataggtaaatggtgagagtttataaaagtcaacatcacattagggaaacttgagcactgacttgctctatttaaagttttcaaacattttatgttgcattaactgtttcctaatcgtaacatgtcaaataatactgttcagagccagatcatttatcaaaatgctgacagaatttttccctaatatatttgtttttaatctcattatttttaataattatccttgttttgtattccataaaatatagcataaaacataggagtatatgaatagaatttgtaaataaataatttttaaattgtactattaaattttgctatttttgaaacaggttccaatatttatttttaccaataacagtcgaggtcaaattaagttagaggacactttttcaactggctttgaagaactctgaatatggtgcattaactgtttactaattgtaacatgtcaaatgatactgtgcagagacagatcattcaccaaaatgctgatagaatttttccctaacgtatatgtttttaatctcactatttttagtaattatccttgtttgctattccataaaatatagcataaaatatatgaatacaatttgtaactaaataatttttaaatactgttacactttgctacttttgaaacaggttccactatttatttttactaataatagtcgaggtcaaattaagttagaggacagtttttcaacttaatttgaagagctctgaatatgatgattctatataaggagcagcctttgtatcaaggcaaatctgacctcagcaacattaacttaaatttatatacttgacatattgataagtgcttcttaattgttgctaattcagctgcatattttatcctgttcgaaatatttgattcaagtagaagtttagaaatgggacttaaacccaattcctacatgttttctctgttcatcgtcctacctagggcacttaatttactcatctaggattgaaattatccttagtttattgatgaggcacaacaagaagaattaacttgtccaagtttatggcgcaaaaatggccaaagaacgttctagatgttactgaggatgttccctacccctgggcagttaatcagtgtttgttttaaggccctgttccccttattctggggatgaccacctcggtgaatatggctgtcatgtacctgggtgggacagcaggtgagaaacccttactgctatctaccctagaacgccgaggaaccagtcttccataataaaatgcttgctaacccttaaaaacagggctttaagtaacggagcttctcagcttcagggggggtacacattagcttgtaaactagaacgatgagagaattgtgatctgcaaatttgtgtaccagtaatttgttttattaaactagatccttagatacatgtgcaacctctgtggatgtttcttgtattatcttctaaaaagtggaaagacaggagctcttattctgaatgagtatttttcctgaaaattgaatgtcatgctttttgaaattctacgtacaataatgtgttactatagcaatgtttgagtctattcttaaaattattcctaagacgaggaaattctaataattaattgtagtcacgttggtaatcatcatcatcaccacataacagcttctgcatagtgcccaagagctgagtagtaggtgttgtattctttacctacaaatgtcactccatttattcttgatagtttgatgttatcatcctcattttatagatgaggctcaggtagttaacaaacttgcccaagttcatggagctagtcaataagaacgatctgatttacttctaagacatgttgtctcctgaggctatgattcttctgctatgacaaattgcattatatagatagaaaaacactgtatttagaaaactgcaggactattgtgtctataattgttctgagcattctggtcaaaacacaaataagttaatgtttttgagtgctatcaaaaattggtttagaaaatatgtataatttaggtgagccagtcacaattggagtaaagattttcatttttattatttcagctagaacacatacataaaaatccagcattttattattgttgccagtaagatgcttccttaaattaaggtgatataaataattcaaaattatattggtcatagagttattgctaagatgatatggtttcctatttgacaatttcctggattgttgaaggtcagtgaaaattgactcatgattgttgattatgactttccaagaaagacatcaaagtagctaatatcaagtgccagagaagtaaattaactgccacagacagagcttcaggatttggactagtttggaaggaacaactatgtcacaaatctaaaagcagtcccatacgatgtttttgtttacctgaatgtaatagaaatgtggtcaaagcaggttttttatttttattctgttgcagtttgttcaccataactccaggggaaagaagtcacagaggccccttttggtgggaggagtaaatctgtaccgtacatttttgtttaagaaatctaacctttcagcttacagatttttttagatcattacccaacagcctagcctttagccctcgaatactagaatacacggcactagaatacacagctagtcagaacattgcttttacgtaatacatttttgaaaaaataagtgatatcacccacaagaaataatactgcttttaaatgaaaattaatatatctcattaaaagtgttctcatagagaatacaattctgttctaacattcattagactatttggccaagacagaattagtgactgagctaaaggcgtataaaatgtgattctacttggagactcagtttccttggctgaactaatgttcttatggttcatcattaatttaaatgatgacttctgtgatggcagttttgagttgcaaatgctgtttttattggcttaaaagacagttttgattaaagccaaggcttagaaaattctcattgtctctgggtatctggtggaacatacttccttcctctccatagctgagtttgcaaggaagtaaagaaaaacctcagggccaaaagggaagtggattttgggacctgagtgataacttgaggctggaggctgagggtcctggttgggcacgttttactctttcagccccaggctaactgggtggcgatggctgtttgaagctccagggtcctgaagataaggagttggagctgagtttcctccgtgtgtgtcccgagcatttcaaatgcatgatcctcataaaggctgagttcaaacttaaaaatcagcccaccagcaaaaggaaatagcaagggaaatataatatctgtctttgcctgcactgcgcggggaacatgaaaggatgttcttaaatttctaaccacaaacctgcctttattctggtttgggattcctttcagcctgcttatgtgtcctgggaatcccagattgcagaaatgaaaaaaagaggcagggctagtgcctgtggacgcctggcagcaagaaaggaagaagctcaacagagggagggcatcctccaccatgccccggagtttcactctcagatccaagtcaagtgtgagtccacaggctgaaattcacccaagagagtcaaaagcaaatgactctgaatgagaatctacaaatagcagaattagaactctaacaattctctataggaaagagaagtaacagtaatagtgactaactttagaggttaaaaaaaatcaaggtaaatctaaaatatgggacaataataaggaaggagtactaaagattaagcagtctcagaatttcactcattcccaggaaatgacagacttcaggttttaattttttttctgttttgttacattgccatatcattcatgcatttatttatatttggattaagttccacatctactttttaacacattttgtctagtttcattagggtataatgaacaaaatctttatacatataaggtatataatgtgatatattgagaaatgattaccattatcaaactaattaacatattcatcacttcacatagaaaacatttttctgtgtgtgatgggggcatttaagatctgctctcagccagaagaggtgactcatgcctgtagtcccagcattttgggaggccgaggtggcaggattgcctgagcctaggagttcaacactagcctgcgcaacatagcaagacctcatctctataaaataaataaataggtaaaataaaataaataaaaagatctactcttaccttagcaaatttcaagtatataataacagtattactagctaaagtaaccatgctgtacattagatcccagggctgatgcatcttcgaactggaagtttgtaaactttgacaattattccccatttcccctctccccagcccctggcaactaccattctgattctaatctctatttctgagaagatgttcttagattccacatctaagtgagattacacagtatttttctttctatgcctgggttatttcacttagaaacaaaaaggaaagagaagaaaacaggcgttctttttgagtctactacacaagattcaggaatggctggtcctcctttctctagtagcttttaacttaatcatgattatttagcagaatagacaactttcaagccagtagaagggagaaaaaagagtctaacaaacacagacatgtgtaaatgacacatagaaaaattatatatagcacaaaacaaggtatccggaatcctaaattcaccgttaaagcatagtaagtgatgtctacgttgaactttgtattttaattgaatgatacgttgtttacaaaagaggcaagtcaatgagagtaaaggtagagtagaaaaatacaccaggtaaatactaactaaaataaccgtggtgttcctatcataatatcaaacacgacaaagattaagatttgtctttctaacaaaaaacaattattggagacaaagagtgtcataatatacataataattttccaggagaggtgacagtgctcaagttgtatgtcctatataacttagcctaaattgtttaaaccaagtatgataatattataagaagatattaataaaccaacgacatgggaattttggattaacctctcgcaaaaactgaaattatatgaaaatcaattacaaggacttatgaataatatcaaaattctaaaaaccacaaatatgtgttttcagaaacaatattacaaacttttctccaggagtcaataaaatccaggtattctggctatgtgcttgccatttgactagtgttctttaacattgtttgccttgtatttacttcaggtgaacaatgttcactaacatccccaacccacactcagtaaagtacatactagtatattaataaaagtataatttttagtgttaacaaaaacccgaagtatacaaataactcctacaaatcaatagcaactcagtgggaaatcaggcaaataaaaacagacacatcataaaagaggaaattgatgttcaatgaacaaatacaaacattaatttcactagtaataagcggaatgcaagttgaaatagcaaagaggtagtgttcaccccaattagataggcaacacctgataataatcaatacttgcaaggatgccacctgatgggacttagccactgtagatcaggtgcattgacttagcaatttgttgaagagtctagcaatttctagtaaaatggatgtttgtgatctctaagacaacacttccctttcaagtatgtgttaaaaaaaaaaaagtgtgcacaagaagacatgttaactgatgtgctttataggtctgttatcaatagtgaaaaactagaaacaattacatttgttagcaaaatggatataattttgtagtattatacaacagaagagactatgcggtagcaaaaaataaattaacttaagctgcaatattttaaggtggatgaattccaaaacaatattatgagtaatgtgccaaataatagctttatattatttacatgaatattttaaatttttaatctcttcttcttagggtttatgaaatacatgtgtatgtgtatatatttgtggcaaaattattgaaatgtgtacatgatgaatagaaatttcaggacccagtactgccagtaggggaagaatggcattgttttgggtaaggactccgactatatttgtaaagttttgaagtttatttttaaaacaatcgttgatcggtaacagagtattactttgtaaatcaaaaaaaaaaagacattttttaaaaactcgaactttgttgaaggatgggccataaactttatgtatgaaaatttaatttttaagcctaaagcttaaggcattttcatagcgctgggatgggtcctggtataattatgaaatgaatgaagctagtttgggagctcctcctgtcctctcctttcttgagatccgctcgctttcctgttctcaggctgtgattttcctgaagagggaggaaaacagtcttaagacactgttcatttcaaatgccagccagggaggggggttgcttgtttaggaaaagattgtctgtgtcccgcattctctctgcgatttgaaagccgttgtgggctggaaagtgacttctagagtgcatggcccttagcttcgtgtgtgagatagtttggaggtaggcctaattagctctgatatttaaagtacgacctttcagaggtaaatgctacatcaaaatcatcagcgttcaaactcaaagcagggtctttgcacaatttttcctttaaagttcaacatttccaacaaacgtctcttctgcaggaaatcttttaaagtcttagttagacatttatacaccttagtgtattaagtcgatgaaataagtttgtctataacatagtcttagaacaaagcaaagtttaaaacacatggcacggccaggtagagatgagacttttgcagccgttgtccatgaggagtggggctcctgatctttctgctgctgtgcccttagagttgcctctaaatattcagctggttacacattctaaatgttaaggactaaatgtctgtgtcctcatacattgctgtgttccacccctcatcccagtgtgatggtatttggaggtaagtcctctggaaggtgattacttttagatgaagttctgagggtaggtggggccctcatgttagaatgagtgcccctatgagaacaagggttccctccatccctccttccttccattcttccctccctccctccctccattgttccactcttccctccctccctcccttcattcttccatcctcccctccgtccctccctccctccgtccttccatcctcccctccctctctccctccttccatcctcccctccctccctccttccatcctcccctccttccctccctccttccatcctcccctccctccttccctccctccttccctccttctctttctccctcccctccctccctctctttctccctctcctccctcactctctttctccctttctccttaccataatagctcacagcgacaggcctttaagataggaaggggtagggtgtgctggctcatgcctttaatctcagaactttggaaggccaagccaggaagattgcttgaggccaggagtttgagaccagcctgaacaacatggtgagacctcatctctactaaaaatagaaaaaaatagccgggaatggtagcacgggcctgtagtcccagttactagggaggctgaggtgggaggattgcttcccccttccacagctgtgagaaataaatgtctgttgtttaatccacttattctatgatattcttttatggcagcttgagcagacaaagattctaatgattttgaaaaaggctattatttttaaagtggtggttgttgttgttagcctggtcacaacagaggcaacagaataatcagtacgctgtagctgaataatgactgcttactttctgtattccctatgcatgcaacctcatgcacattaaatgctagtggcattcctacgaggcggatgctgttttatccttggcctaacaaacgggaaagcggaagcagagaggtatttggtacccagtgacactgacgttagaatccatacctaagactgctgcaccctgagacctatgctgtaaccaatgtgatgtatttcctgaaacagtaggacaaacttttcaccaaattttcctatcccgcagggagagaattttataaatctctatttcttattttaaaaatgtaattgaaaggactttattcaaaactgtattgaaaaagggctaggaaatatgaaaattaatagaaatatatgcattcttaaaactattaaggaaggaattcttaataagcctaaagagagagaaaagtgcaaatccatgattatacatgagatgaagaaaaatggtaatatataattttctaaaggagaaaattattcaacccttgaatggatggttaaaaatagttatcatttaaaactgtattgtaaaataataagccataacagaaagggtacagaaagactggtataataaaattaaaatacatggcagaatagtattagtctctttcaataaaactctcatgcttaaaaatgtagtaccataatttataactcaaggtcaaacttttagtaatttgccctaggtaacaaatgtggtgagtatgactcatatagagtatggcgagtgtggtattaaaaagttctaagaagagactgtcaattttaaaatgatgacacaggcacttttcctagatggcttgatcccagtagcttgcatcatttggaagttacatacttcttccagattgaatacctccagcctgtgattagaggtcagcagcccacggagggaaagcggaaggaaaataaattctgcaaactcattctgaaccacatcgtccagtagcgattctccccctttatgcgatggtgactcttggagggatagctgttctttgctcataactcgactttatgccaggccctgactgcttggccctgttgcaagctgcttgagagcagggcactgccctgtacctcactgcccgtaactgtgcctggcgccttccttcccccacaccacgcccggcccatctgctgggattcttcctgcagtcacattagccatctgtgacttggggcgccccctttcatgggtctcactgattctcaaggtggttttctctaaagtgagggtaaaccccttcccatggggttttaaagataaaagtaaatggtgatgtcatttgattgccatgtttataactgtttatttctttatacactcactgagaacctccctttaccagtactcggttaattcatgtctctatatcacctcttttaatcttcacaattctgtgctattttcagaggagaaaagagaaattcagaggggtgtagtaatcagagcaatgtattcatttgaggccaaaagtaggagctagaaattcagagctggtctttctgcaaaattgttgtacatttcactctgcatcataagcatcgtgaaacctctgttaagggactcaaagcagagagagaaggttggtttgagcacaaatgcacttactttgagtaaggacaaatcacaaacaaatgaagtggaaattggcataaaaagctctggcaggctacatagtgattagtactgctcagaaagcattttgcaggggagcaaagtagtctgggattcacctacgtttgcctacaacttacaggaaatatgcaatcgttgcatctaaaaagtggtgttctttccatgctgtatttatgagataaccctctctaccctgcacgtagtcgtattttcaccaaagctttattggacaccacgttaggctgtggggagaaagtcaagaacacaacaaaggctacctctgccctcatgggtttaccattagcagggaggttagaaaggaaagtctgtgaagtaaacttaaaagataggcaaggccaaggccagccagtgccccagaggaggccatggaatggagctggggttttctttaaacatatattaattttagaacttttgtttaagtctatgcttagattttgtagaaataactcacagtgcctaagataattcaactaccttaactcttcacgtaatacatattagcaaagtccaaaataaatgatgcagtgcgaggttgttgctgataaaaatcaagtataatcaactttatgcaaagatttctgtgtcttagaaaaaattctatctagaagataaaaacaaaagtgattgcgacttttaaccggttaatccactgctattgcacatttcaaatgagatctataatgaacaagtctttatagaatcatttttatattatttcaaagtaagtgagaaaacagcaatttttactgtttgcatattgcgtcctctttaatttttttgctcagtcacctttctctgggctctgggctcaagaacaatgactgcagatattaacagctcccctcctggagttcaccaatataggaggtctttgataaatgaagagtatgataaagaaaatattcactggataaaattttagtcaaatccatagggactgcatgcgctgcttataaaaattagttggcacccatcatgctctttccagcatgggataaagctctatgtatcatctcttttaatgctaaaaactgatactctcaaaggaagaagtagagagaccgaggggttaaaccatttgagcaaaataataaaaaaggctgagaattgcttgatcaactcctctatggtacgaggggattggatgaaaataactctgagtgatcttctggatttagtgctctgttaaagtcgatggttatggagtccactccagtcatgtgttgattagtgatgggaatgtattctgagaaatgcctcatcgggaaatttcatctttgtttgtgtgaacaacacagaatgtgcatatgaccacctagatggtacagcctgtggcacacctaggctctggggtgcagcctgtcaccttgttagggtcctgcagactgtaggcaactgtaacacaatggtaagactttgcagatctgaagatacataaccatacctacacatggaaaaggtacggtaaaaatatggagtgaaacgtaagaatggtacacctgtctacggcagttaccacagataaatcttgcaggcctggaagttgtccagggtgagtcagcaagtgagtggtgagtgaatgtgaaggcttaggacatgactgtacactactgtagtcttcataaacagcatacgtttaggctacgtgaaatttatttgtataaaaaagtaattgcactacaacattatgacagctgcaatgtcgcttagtgatcattgttcagctccactataatctaaggggactgctgaatgtggcattcgttgttgactgagacatcgtcatgcagcccattactgtacttccctatacaagcagactctccatagaacgaatgttatcaataatcgaattcctgattctgtgtttttagggaagtaactggcacaggtgttcgctgattttatttggtgaagagagggaaagctaaagataaaaggaaaggcttggcgtggtggctcacacctgcagtcccatcactttgggaggccaaggcgggtggatcaccaggtcaggagatggagaccaccctggctaacacggtgaaaccctgtctctactaaaaacacaaaaaaattagccaggcgtggtggtgggcaccagtagtcccagctacttgggaggctgaggcgggagaatggcatgaaccctggaggcagagcttgcagtgagccgagatcgcaccactgcactccagcctgggcactagagcaagactccatctcaaaaaaaaaaaaaaaaaaaaaaaaaaagatggaaggaaataacgaacgtagtgtctctttgtagataagaccagcaggaaatgtattgttacctccttagcaataggataataatggtgttgattatttgtctttcacataaatacaggcaaaattttcatcagctgttttttttttcaagtatataattgaacaaccagaaaattgatgtgtgtagttaagcattacttagttggcaaattttatattgcagaatcaatgtatgttgcaaacgattgtgtgtctattaagtagatctggccccttccctccagtcttttacttgacagatactttctcatctcattttactgctttgaagtataccagatcaaatgttctccaagattaaataacatcatccttttcttctttctctatcccaggggcttaacctagtgtctggtgcatagtaagaacttaaacaacaaatgtttattaggtcctgatatggtgttccgctatgttctggtgtgggaaaaaaatatataaatttgagattatggactcaatgaaaaaaatgcatttaaatgcgtaattataatatacagtgataagttctatagtaggggaaaaaagagacaaaacatgaatattgaagagagaatgtctaatttagcctcagggtcttaacatcaagctttttggagatgtcattttatctgggccatgaatgataactaggaatggggcgggatcgtagaagaggagaatagaccagatagaatgtttcctaatgagtttatcgttttagaaaatactcattcaatatccatccagttccacagataatcctagattttgccagaatctttttcctctaagagcttgtagtctcatcgtaagacgttggcacatgaaaaattttgttcagctgctggtaccgataatccgacattggctttaaaactcataggcttactgggctgtcatgaaaagtgcagtctaaaagttggtgtgttctgctgccatgggtccagccacttaagttggtcatgaacaaggcacctgaaattctctttgcctttcactcatggtcccaagaaggctgctgcaactccagtcatcactggtgcatccttggcatggagaaagtgtacagaagaggcataaatgtcagtggtgtatgtctgccactgcagtcccatctaaaagcgctctcataattcctgtacaaccaatacaaccaatgagatattgttagcatttcactggttaactccacataaaagcctgttccatttttaaactgggtgttacttctggagactatatttgggttctataatgaatgaagatttctgagagtagacattgtgtaggtaagtagcagtttctgtcatagggtcaaattctaaggagcattttatggtgtttgaggaaacaggacatgcctctggcttctcaaaagccctggaaatgtattagagtgtaactcaagttctcattcaggtcccctcgagtttatttcttcccaagtctcagtttttgttttgatcactggaaaaagacaatacataacttcagcgtctattggacagaaaagctagcatgacatattcttcattgtagagatatgtgttgcacaaatgttggagtgtgcatgacagaagacaactcacaggaaagatgggcagaaggctgaagccaggaacggaaaggaaaacgtctatgcctgtttacctttgtcttgttttaagcttttttatccatctccccaccccagctttctatatatcctgaaagaacagaacaaaactgaaattgtgtgtttcagtagttctctaccacctgtactgtttctttgttcatcagtttcagtttaatttctgggaatgatcttctgtgcttaaagaaattcaagtaaacacaactcaaaaatacgtaagttctctatgcttgtaattagctctgttttctccttacctccattgaacatctttcttcccctctactctctttccctcccttcccattcccacattatcctcccctcccctcccctcccttcccctcttcctccaccctctctctcctccatctctcctcctgcatctctcctcttccatctctcctcctccatctgtccttctccatctttcctcctccatctctccatccctgcatcactctcacacacacttgtgagatgtcacaactgtgacgtctcatcaggactaggtacacatacatttaactgtccaaggtctttgctccccaccaatcccagactattaaatgagaaaagtgtcatgattcagctgccagtgtgtaatatccagacatgaaacctgtctcatttacttttgggttgggatagagtcacctgtgggatactgccctgattaaattgcttagagatcatttaggctatttattttgatataactatcttgtcctttgtcttctaatatgtgctcctacaacactgcatggtgtaggggccttaattgccttttgggtcttgtctcatgttattgctcaaaatacaagaactttataggaggacatcaaagcttttaaataaaaccttccaaactcttaaattacattttattaaatgtggcataatgcaaatactatgacattcttgtaatacagtactttttaacattttttttaaaaagccttccatatacccatgtgattggtgagggaaacatatattgttagctgttataggttttatttattgtaaacttgttcactttctattatattcctttcttcattggccttgtatacctttatacttttctcttttaaaaaaatgatttataggtagccttcagaaatttggcagggaaaatgtgactacaacatttcacaagcacctgcagattactggcttgaatttgtgtccagtatctaaaaatatgcttgtcattaactgtgatttaggaaatatcagtgtctaatcaattcacctagtaacattcagggaaacgtgtcatctgaagaaaagagctcagccgtgactaagaccttattgtttaagaggtgctcttttcatcagggtagtaggaataccctgtaaatagtgacaaggtgttgacatattctaaaaaacatttcaaccagtacaattaagcctttcaacagagaaaagtaatttttgagttactggcatatttatacatatttacagtttttctttgcaaactttctttagatttgctcaaggaagggacttctgaaaaggcaatatttgctgagacataaaattataactgataattacaatagtatctaatacagtgtggaaggaactgctgtactattttggtagacctatcaattataatcgtacatgagtttattaaaagaaaattagctttccattctaaacttttgagggttgacttcatgggcgatatacatataattccaccaagagtcattacaccactcagaataccaagtcacgtggacccaaatatcactcatgtattacgcatgttccccagggagcagtggctacaatattggatcctcaaccagcatcttatcttggggacactatgcacagagtcacattaggggacacacattctgtcttcatagcttgcacagctatggaaaattccaccaggactcctaagctgagctgggctatttatatcactagagaggctttttgttcttgcaggttgtcttagtacatttgtgttgttgtaacaaaatactacagaccaggtactttgtaaagaaaagaaatgtattggttcacagttctagaggctgagaagctcaaaatgaagtcactggtagttgatcaggggctttcttgctgagtcatcccatggcagaagggcaaagaggggtagcccactctgagagccctctttattggggcatcaatttattcatgggtacagagcccttatgacctaaacacttcccagtaggtcccagctcctctttatatgggcattaattcattcataagtgcaaagccctcataacctaaacacttcccaggagctcccagcttctagcactgcctcattggggatttagttgccaactcaagaattccgggggtcaggggacacattcaaaccacagcaccatttagaagaatttctaaactgacactgtgttcttcatttccccaagtgccccattaattcccccattaatagactttgttctccagtactgagctacttctgctgaggccaagtcttccagctttatttcgctacaacagcggtaggagaagagagctggcagctctcaagcctagagccacgttccacactgtgttgagcagagaaaacatttcttaacaccattctctcaatacacagcttcaagctaagatggttagatccgctcctcaggtctccctgagagtcacagtgcacgtcagtagaggagctctctacatccttccgcattaaataaaatgtttaaccctgtttacatcacgcactgtctccatggttgtgattataggatcctttttcactaacactattagtttactttgcaaaagttgttttctgtggaatatgctacatgaaacatccgtagactgaacaccgctttattccatcctcttagaaacaagtggctttgccaggtcatcttcatcctaccttccataactttagaagtaaaagacaagataataaaagagaaatgtttgcccttttctatgtatgttaccataaattcctcctaatctcctggtgacactatcaagcttcaagtagtctatcattctcttaatatatgttaagattatattttcccacgaaagtttggtgtaactggggaaaggttgagaagtctgtagtggtgatcatgagtgcctaacagcaaggaagattaatagtaaattcattgagtagcatatgccaggcactgttgtaagttcattaaatacatggtctagtgtttgtttatgttttgaattatgatattaaaagtagcattatggtattatgcatctacatgcattaaataggcattctcaatatggtctaaatggatttttttttccaacagaaaactgttgagtgacttttgagagttagcaattgtttttggctattgggatacatcagtcaccaaattaggcaaagatttttccattcagaggaggaaaactgacagtaaaccatgcgcttaataagtgtaatgtaatgtcagttgatagagatcacccaaaaagaagagcaggatacaagtgttggtaatgtctagggcaggacaggaggctgatggtgggtggtccttaatggtgtaaaatgaagtgatcagaaaaggtcttttcgagaagttcatatttgaacacagatttgaaggaggtgagagagttagccaaagagaaatagaatgtgtctatggcaaaacctaaaatcctcctgttagaagttgacatattaatgaatagttcaaaagtattcgtaagtaacgactgacctttttacttttaattaggatcttatgttcaagtggacgggctctcttcttttataagcgccatgatagtttcaccagcaaaccagcactcaccaagggatgagatggtaaaagcgtgtttggctgggagaaactttcatgcattgattgattagtatataaattcagattgtttgtataaagaatagtggactagaaattaagacttgaatgttcctggactagtcctgccaactgtctgctgttggaaatggcatgtcatgtcatgtcatgaaatttccagggcttcaagtttcaaagcaatttttttcttctaattacaaaatagcccatttgtttaaaaaaaataaactggaaatatacacaaaaataatttcagaagaaagttccttaacaatttccattcattcaaatgatcataaataacttctctaaatgaaaaatctatatacaattatggagagccaacttaaactgaaggttggttgaagcaatttccaaaagaagacaaaaaattatgaatatttgattaatgtacctacatcacattaatatctgggtgaaaatttatccctcaagaaaaatttgtacattgtatttctataacgatgtgatagaatttattaataatgtcacaaagtgaacttaagcacttgctttggctcccacagtacttttttcagattctattttaaagttgtaggcttccaaatcagcagttgatgatacattttcaaaagggcgttatagtatgtgtaccaaaataaaaatgcagaagctcatacattacaaaattaatttcacatgttgaatggtgataacttacttgaaatctacctctgctcttctccttgtaattatgtaatgcagggccatttaacaagaatggtggtattatgcggaattcttaaaagcctttgattcttcgggtactaataagaaaaagtaaatttctacaccgaaagaaaacatgagcctgcataaatattgagatagaaagcatttttcatgaggctgctcttcagtgtctgagtgacacagcaggagaactgcaagctggagatgcaaccaattctacaactgactctaccttactcgtaagagatgtccacacccagcagcactctatgtggtatgacagggcagtgtggtagagaagacaattgaccacccattgattatctaagtgattttgtctttggtcattgtactcaatagttacttgagggtccctttctcgctgttccaggaattgttctagagaaatgctatgcaaactgtgttatagagcataaaaaagatgcggaaaagaaagcaatattgaggacggtgtgatttcctttccttttattggcgttttcttcactagaccgtacaacccatggggtagcccttggatgtcttcttcactttatattttaaggttttgaatgatatttagcacatatggggcgctgagtgttttataaataatacaataaatttctacttcgtctaaagtgtttccatagttttcaatattatctacattctctcttacaaagattttttgaagaaacatttatgcacggaaaaagtgtttaaaaagtcactttgtagattatttgagtgttcagctctaaattctatgaacatttatttacaagtcaaatgtcctatactacatttctttacatttcaaatgtcttaaaaaatcttcttgatcctgttttctttatttaaataaatacaatcattattccaatgataaattaaaaaacaatgaaaaattaaggaaaaatgggttaagttgttttttgtttcttttgcttgcctcagcatttgcagaaattcatttctgctgaacaaagctagacccatcatatcaaattctacaggagaattgcaaataattattttaaagaaaaccctcatgaaacatcttaagtaaaaaaagtaattttcacaagggtcttacaattttctttaaaaactcttatctctgtaacaagaccaattgataattgaggtaccatacgaagaaaatggagtgccctttctctacaacttattaagaacttcacaacagcagctgcagaatattttatcaagaactactcttctaaggactgaccgtgtcctttgcaaggacgtggatggaggtggaggccaatatgctaagcaaactaacccaggaacagaaaaccaaatagcacaagttatcatgtataagtaagatctaaatgatgagagctcatgaacacactgggggaacaacacacactggggccttttggaggatggaatattggaagaaagaggggatcaggaaaataatgggtactaggcttaatatctgggtgatcaaataatctgtacaacaaactcccatgacataagtttacttaagtaacaaacctgcacttctaccactaaacttaaaagttaaaaatcaaacaacaacaacaaataactgacctaggttgcatgttcatgagaccatccctgtccacggccctgatagattgtattgtttagaaggaaaagtcattttaatgagttgagaaaacgccttagctaaagcaccatgtatgaaaagtataccctgtgagatgtcctatgttcaaagattatgtgattatgtaatgatgtgattgtgcacacttgtcaataattttttgcctaattttgttaagaaaataggaaatatgaaaacagagttgggtgatacggcctgacttagtcaccaagaagtgtatatcttagagcacttgaaaaaattacctcacataggataatttaaattgtcattcatatggggtagattggttatctgaattcaagatttccttggtttgattatgacattgttgaccagaggaacctgttgaccagctgatcgattgtgaactcacatttcctctacacacctcatgtttagcatcccagcatggagagaccatggattgggaaacatccaaccttaggctcttcatgaagagtttttgtttgctgagttgggtgtctcgtgattgtgttgagcaccacctaacctgcctcctcctccctttgcatcatcagagtgtggatcaggctgtcagaaaaggcaggctgggtacttgcaatctttcctcccaccccaaccctctgcagcctcacaagcccaagtacatacttttatgcagtgtttgttgtgttaacatatgtagagttatataattcattgcgtaatgcaggtgcttgatttcatccgatttagagttcagaaaaccagtggtaagttacttgtttgacagcatgccactaataagatggggaatgagattctgaacccaggcatttccatggaacattctgtgtgaagtgaatattgaaaatcttgagggtcgttattcattccagacaggttggcaaaatagctataatacacattttctaatgaatggtggttttatagtttaaatgtgtatgtgattctttttgatgtttgtcgatttacttccactccaggcttttggttattttaaagtttatttgttttcaagcaatggtgatgacaaattggaagatttaaatgttgttatctccattatatctatcaggagtttaatatccctaggggatcttgttacaatgacaccagaaggaggtcagaacatatacatacatatatacacatattttatacatacgtataaaatatcccttctctttttctttaagtagcaaaactcttcactgtaaaaaaattattccattgaggtaactgagttttctagacatagaggaatgatgtgtgaaaataacacaatttaaatctgtcatgtaataacttggatcagttttgaagaaatttgtcatgttcagtgcactgtttttctgggagacagatctacaatagttgatatttacgcagtattttcccattaaacctgataagaaaaaagaaagaaaattttatttgacttgctaacactcttcaaactatttttaggttatccaaaatcatacatttataactttggctttttaaaaaattatttgacaaaaatatacaggcctgcttttctactagttttatgaagatctattaacataaaaacatccgtttctaggtctttctacctattaaaatcccagttcttggagctccaggcaaagtttcaggcatggagacaagactgcatagtgtttcccgaagacccgggggcctgctctcagtgcccctgtgctctgtggaacgtttcaagcctagctgttactgttgctgctgcttggtctagctcagctaagcctaaacggttctaccagaaacttgcagagctgcctgtagcacaaatctacttgtgctgcgcgaaactcatccgcacagcacccagtagtcatcttcagatgcacagagctgtccacaacaggactacctgcactttaacataaaaacaaagagcctgcagccaggttaaaatgcagcttcccactccatggcagggactgaaattctgccactgtaacccgttcccacctgctactgatgattgtagttggaggaagtcactttgggaagcaaactctctgctaacctaatgtgtttatgggagaaaacaggaaccacaaatcaaggcaataacacagtccctactctgttttcttatacatctttgtttcattgtaaagatgaccttgtcatgatttgcttttctttctttcctcgttgaatactagaatgatgacacggcaaaatgagtgttcttttttgtggactcagattatggatgtacgataccatgagatggaaatttaatcaaaaattaagttgcaatatcacacatgtgttttaagaaactgtaataattttctgtgttttcggtggttaaggaaatagtcatggagacatctctccttgcataacttatttactcatatgcttgcttaggggtaatttccccatttctctggttacaaagataagcctgctgtttaaaattagaaagtttctgttttgagtagacatactggctagaagccgaatctgggaagagtgtcagttacaggggaacaaggagcaaagtggtcagtagaggatgagtcattctctccaagtcaagctgttttttgggcccctctcggcattgcataggttttcaaagctttagtacagcaatttcagatttagccaagagcctttaccatgaaattcagacctagttcatgagactaggtaagaaaatacctgagctggtgatctcccctttcctgactctcctaatagccaatcgctctgccatgtcctcctcagcccagagcagaggcttccatgcaagcactctccctcctctcctttttccaactgctcaatttgtctgattttccacagtgaacatgttccggattctaagacctcatggcaagaaaggaaaaaactacccctgacccgtgtactcagataaaacctctgccattctagtctgtttcctttgcattttaacaagttagtgccttcactacacataaaattttaaactttgacttttcatgcaatgttatatattgatctttttttctgggtcagaaaaagttttagaacatacattttaatgactttaatatttcatcctgatgctttaatctaatttacctagtgacttcactaatagtcacatgtcgttggtgaatgaaggtttcctccaactttataaatgaataaattaccatctttccatccagggatgttcagattgtgccctgcaggagagccactcaactgggcagagtgggctccactcacagcagagtgagccctggattggggtctgtgaacctggaaggagggaatctatttccaaacacacaaagatgcctcatgaactagcagtagtctggtttatttgtagatacattcattaacatttctgagttttttcaagacaacttactagaaggggaaagactagttaagaacatttttaagatacttaataaatatgaaaattgctctcaggaagtctctgctaatttatgctcacaacaatagtcctattatagcttgaagtattatgatacattttatccttttctcatttgctgggtgggggaagtgttttcttctctcatttacagctctttgattacttagggaggttgcaaattttcatgtttactaatcacttgtaattacactactatgaattttccagtctgcccttcactgtaaagcattcacagaagatgatgtttataaagattggcaaatttcttatctaatttccatcaaaaatcacaattcttttatttaaagtttttaatataccattctgagaaggatgtctaatttggtggatatatgctaagaaagacatataattcttagagcattctgagaattcatgatgatgcaaaaattctgcctggtgataaaggttaatttaccctttttcatttcacaaagtcaaaaggtattaaaacaaggggcagatgaattggtctcatttactttaaagcactgttggcatgttaatccgtttgaaaacttatactgaatctggtcaattggtaggacagtataaaatagcttcacgatgttgtctttatgccttgcattctgcctccatctttctctctttttttgcacttaaaaatcaccccatacttgggaggctgagacaggagaatggcgtgaacccaggaggtggagcttgtagtgagcagacatctgagatcacgccactgcactccagcctgggcgacagagcgagactccgtctcaaaaaaaaaaaaagaaaaaaaaaatcactccaaatcccatttcttatctggatggaagaaataccatttgtaatgattttgatcattgaattatttctcctctacatagaaatcctctaaacttgtgttccgggtatttagggtccgctgtgtccatcttttgtgctaagcatggacatagagtggtgcactagagaccctgccctcctgggggcacagacattcaaagacacatcctcactgcatgaagcgacttctgcagttggagatgtagtgactgagataataaagtgctatgaggaagtttaacatggggttagcaagtacttaagtgggaagggtttccctgaggacctgctactcgaaggtgagaactgaaggaaaaataggcaaaggcgtgaaatatgttccagggggttacagcaggtaaagggaatgaattgtggtgagattatttagggccctgtggtgtatatgaagggtgtcaaattctattctagtgtgctacaagtcatggactttgtttgactggagagttcacgatcaggatttcatttgtttaagaagacaagctgtagggccatcagtgaagctagggttcattgaaacacaggtttagaggattctatgtagaggataagtaattcagcgatcaaatccataggggtagcttcattaaaagactaagaaataacactagtcagtcagatgggttttcactgagacgttggctggaaataattgaacagacttaaagggtatttagaaggtataattgtcagaagttggtaatggaaaaataattttaaactattttctttacagtaacatgcgcctgaatgaatacataactcaatattttaaaaaatgctaccccatgctacgccctcacatagacaccaaataaaaaaatagatagtatggatatttttggctgtcacttttattataagaaaaaattaaattcaaagggcacagaaaaaaggaagagcaacattggcatcaactgcattttttaaattgtggtacatttacattaggggatgggagccaggagtgtataaggggagtacttgttgaaaggcactgggaatgagattggatagccatcctcagtgtgaaaggagttcattttgagctaaaagataaaataaaaaggcaggaggcacaggcttctaagaggacactacacaatcaggttagtttccagattcttgctgcaggctttgtgtcatttcatcttattttagattgttatctgagatgtggaaataagttcacaagtgaatcttgaagtctacagggatcagagcaggcaaaggtgctcaactgtgatgcctgcaaaatggggcatagccagaatgcaggagtttcctttttagcaaagatgcagcaacaccagaagtttaacttgtacaaggtgataagggtcaaagcaatcagaggtttcccagtgaaaaggctgccagcccctcatgaaacaggttagcacaagctacgctctgcagccggttgtcaaaatcacagttatgggaacctcagtggccttgtttatttggaaatctgggattaaataatgtttattttacttttagatagaaaaataacaatcaacatttggtttagtatttaagaagctttatttaaagcttaattgagtaataaaaatgcatgattttcttgtcaagaaatatgtgggacttcttgaaaacacagaacacgccttatgtatttttaagaaatcactggtaaaagaggtttggatttaaaagtgcattattttttgttatgacttactaattcaactctattttacttatgcaaattgctaatgctgcaaaggataaggatactttgtttttcactatattccaaaatagtgtagacacattcaggcagaaattgtgtaaatatcttgaccttttctgtgagaatggaactaacgtgaaagatagaccattgtcatcattaagaaaccaccacccacctttccacaataaagcaaccagttttcccaaaacaacataatgcgatgttctgccacccaacataatgcaatgctctgtgaccccgagcatggctgcagcagtttgggttctctaggtggaaatgccttctaagagaggcaggtggctaggggatttactggagggttatggggtggcacataacatgctggaactgctttggaaccaccaaaaccagctctgaggaccagactggggtggggcagctgatctgagggtgctacatctctccttgcactgatggctccaggacccagcctccaggagaaagacgagttaagatgaatcacagttagatagatcccaaccatggccaaatgagaaaacagcttcattggcagttccaccaaggttgaagggcagaggaatcttctccttagcactggtgttgcccacacaaaaagaagaagttgatgcaacagagtacatccaacctcagcatccactgtaatggaattctgagtttggcaggatgtgaaacgtgagactcaactgtatctctaatgtaagaagatagttcattcaactctggtggagaacgtaatgattttaattggggagtaaattgttttaacccacataatctcccttaagaaaatactatgtgacataagtttaaacatttgaagttatttttgttcagggatgtgtgatatttcagcaaaagcagattttcgaacctaatcctgtagccatagtgatgggaagcaggaaaatgggactctgggctgtctactctctacagaagaacagggtagaaaatcatatgtagaactattaataaatttaacctagaaactcaaaaaagcatttgctaaaaaaattgcatttgctatcgatttttaaaaatgtacttattagtatgactttgagtgtgggccaaagcatttacaaaagttactgcctaagtcttctttacccaactgggaatgtaatggcaatgaaaactttaattggaagcaagagaaggataatattgacctgccccaaacagctaacaggtattgagggccaaggatagtccagggttgttggcttcaagacacaggaatgacctcattggtttcattcttcctgttttttaagtgagaagactgaagtcctttagagttaagtaatatggacacattgtctaactaatcaccagcagaatcaacctcaagcctgtctgaccatggggcctgtgcctctagtcacctcttaatgtgcctccttaccctaaggcagtgtgctcccatctttgtccatgagggaatcacagtattgatttgtgactctagggtataccatgtgtgctcagggcggagttagcagatgtgctttgggctgccccagtccttgctgggagctggaggaccaccctcgcgcacatgctgaggaggaccaagctgagaaggaggaagcacattcattcatgtctctagtccctagtgaaagaatcacagggtctggcacatagaagaccctcagcccattttatagggtgggagtgtgttaatatcgacgtacttggcattctaagatgtcctttgggattccaggactggacttaccagacatttttaggccaggggcagacatgactgaaaaaattgtgtctcaatcttaaaacgtttacaatctcttgaggcctcctagggtagaaaaactaagcaacgtgctggaaagcacatgatgtggttcgtcccgcccagtaggcctgtgcatgcctctgtcaccctgagccaacccaggagacaactcctggagactctgcttctccgccagtgagaggaaagcttcacattttattatttagatagacttctgtttaaggaacataaggcattgtccagaaaaaaataatacaatataaagcttccctttttaaaaattatttttgggccaggtactgtggcccatgtctacaatctcagcactttgaggtgctgaggaagaaggatcacttgagcccaagaatttgagactagcctggtcaacatagcaaaaccatgtctctacaaaaagtaaaattagctgggcatggtggtgcacacctccagtctcagctactagaaagggtgaggcaggaggttgaggctgcagtaagttgtgatgacactattgtgctccagcttggttgacagagcaagactccaactcaaaaacaaaaaaaaaaaagtagtattgactgcagtatagcatcatgttcaagagtgaagaccgtttagccatattaccttattcctcacttcaaagctcttaccgtttagggtatacatattaaatattcacaaaaaactgcctgggtgtgtatcaatacctcattttatataaacggaaactgagtctcagaaataatgttttctgttgaaggattagtttatttactgttcaaggagttaacattccctctcaatatttgtttcttaatataaacaccctcactctgaatctcttcaggaccaaagggcaggacgtctacttcggaaaaaattaaacaattgatttgcaaagttggtgcaaatatggaaaggcgaagggagcttgatgagtttcaatcagtaagaatttctttagggcttccgtgcaaagtagctagttcttgatggaggatagtgagtgaagaataaaattgtaggcgtaatcataaggaggttgttatctgtccatggcaacacatatatccatgaagcaatggagcgcgatttaagatcttgtgtgtgtgagaaaatagttggtcctcagtgtaactgcttcctgaggaaactgaacttgaacttgtttctgattacaattttagctgagaggcctggaaattgaatttataccattgcctggcctgtcactgatgcttctgttccattttgttcagtgacttctatatttggaaagcaacatagacttaataatttgggctactatttagtaattgcccaccttgtaaaatgtattgagataagccattttaatccagcagtcttcgaaggcacagtgattattgccattttacagatgaagggaccaaagcttgaagagtttaaataagcatgcaattcattattttaacattgattttggctgaattcttttaagaggtaggtttagaacctaagcttaaatttgtcagctcatttagtattgaaaactttctatcacgttgaatttttctaagtcacatgaaatctcgctaacttttttgagcaaatcatctcagattcctactctggcccatgaatacagccagttgtgtttgttgttaaatgtcacagtgttacccggggtgtaggagaaaaattcttgactggctagagtgggtgcttcgtctcgtcttcacccctttctccgagtggggatgaaatcttggtttgtgtgactcatgcactaaactactatactatactgtttcctgcgttctagtttctgtaagaattccgatcagtgtgccaattacaaataaagcccctcaggaaggtaggtgatgcgatggattatagatctatgaattcccgcagacgtacatcatgtgttgtccgtggcatttcagttcctgatcgaagaccttactgataacatacggtgtttttatcccaccgtttgaagccctgtgctgggcctacaggaaacctggaaaaaatgaaattacaaaaaaaaaaaaaaaaaaaaaaaaaaaaaacaaacaaaaaaaacaatatccattaacctctttgctcacagtgattatcacgaatcacttgctaggtagcttagcattttggcaactaggttaatttcacggtaaacacaaatggtttgttggcggaagctgcggctcagctacgggatgtgtcagccggttccgctattcctcagttagaatcaaaggatggcaggatgtctcctctcctctgagtgttctcaagttacaaaaacaaatgtttcaaagaaaaaaagaaaaagactaggggtccagatgggggacacattttttcctcattacacttgcatgtgagaacttacatatcacaagaataaataaaattcttcaggaaaacatggcaacaggctgacccattttaaaagggtcgatgcatttcaggtcctcagtaagttgagcaggccagtgtcatgagatccctgagagaaaagactagatggaattctttataaaagcacaagaaaatattcggagcactttgagtagattcatgtatgtaccattacttagaagatttgttttctaaaaagcatgtgaattaggtttccaaatcacactcagcaggtacttgtggacatggcatactacatagcctttagagcattaggtgtgctaagtaccctgagtaaaaacaaaaaacaaacaaacaaaaaaaaaacaaaacacgtcttttgattaatgagtatgaatggctatataaattttaaaatttctttttttccagtgcatttttgtatgtgagttttatgatgtagcctacgaaatctaacaaaaatgatgttgttcgttttcttttttgcacccttggtccattcttgagtttggacaggagagagatgcctctgaaagatgaatcacacacactgtgggtggagacggaggaagtcttttttctaggattaaagcaacataatttttctattcttgaagtcccctggaaagggactcctatggatggaatgcgtccccttaaattcgaatgttgaagacttaactcccaccaatacgatggtatttagagcttttgggataaaattgagattccatgaggtcatgaacaccccgcccttagaatcaagattagcacatcagttacaacagacaacacagaggtctatttctgttttttgttcacacaccgaggaaaagctacgtggggacagagcaagaaggcgcccacagtgcagagactgttcttatctctccaaccaccagtttctcatgattatctgggggcaagttagcccagatcttttgttctgggagcagccacgactccagttttcagcggcagcagcgacaccgtgtggccgtacaccacaccattcattcattaacaagtgtttatttagcacctgccatctattcgtcaggtgcaatcttccatgtcctagaataaaatggtgaataaagtgtaaatacaaacactcaattaaaaaagcagcgcagaattgtactaaaggaacggccaaaagatgggataggaacatttaggagtgatatctagtgtagactgctgaattcagacctcaaggataagcaggtctcaaatggccacacagagaaatggacgtcttggtagcaaaggtagtttccatggaagagcagactgaggtggttcaggaatgccggtggctgccacacatcttccactcctgcagagaggctgcttcaggagcctcggcccatttctaaacttgtgtctgcaatcgccagctctatggatgggtcccatagatcacttcgtgtaagtcttgttcattcacaacctcctgctttagtctggtggcagccttcgcttacagatgtcttttctgttcatctttcttggtctaagtcaagagttaactcctgggaatctgtgctcagtcctatgaagaataatcttccatttcatttaactcctgtagcacttgatgtacttgtgtaggttagtacttaggcaggggttaatggttgacttatctgtttcactggctgatggtagactcttaaccagatgccagaacctctcaggcagaagggatcacatgttcccccaccccccgccgttttaccttaagctctccatgcattagtctcacctcattaaggcattttagggtgacattggttcatccaagtactggatatggcttccgcttgaaattctcaggattagattctttatatatggccaaataataattaaccaactcaaatgaaatttcatgaaatatcctaaagatactctacttcttctcagatattatttgtgcatttcaacagagatcttacatctttattttattaatatcttagtctgttggggctgctgtaccaaaattccatacattggatagcttataaagcacagaaatttgcttctcacagatctggagcatctgggcagtccaagatcaaggtgtcctggttggggatcatttcctggttcatagacagggccttctccctgtgtcctcagacagtggaaggtgtgagagagctctctgcgtcctcttttataagggcactaatcccgttcatgaaagctccttcttcctaatcaaagcatttccaaaggtcccatctccaaataccatcacattcggggtcaggttttcaacacatgaattttgtggaaaacactttcagaacatagtacttagtcactgagaaaaactaatgtaggtacttttaatatgtcaatgaagagaggtttttaacattcaaatttgagatgtggctggcggagagtgggcacttctgcatacaaagaagctgatcttccctgtcacaacagtgttaacttcaaaaagaaaaagaaaaaattgaagaaaatgatatgttttcaatatgaatgttgttgcttctattaaaatgcatgtcattgttcttgaagctggaacgttgtggataagtgatagcattttccaactgtgcagttcagtgccagtgcacagaacaatgagctttaataaacctagagcaacatatccttgtggttttgatctgcaggtgcatgtagacatgacaccacgtctatcctcttcctgtttcctccttttcttatgaataaccaaattatgcttgactgcagaaaactttttggaacaaagaattcttgtgaatttcaatatccttttcctccttttacacttattcaagattgttgcccctaaaataaatatataaataaataaataaagtaatgtttgtcttttagatttcgaggcacctgacattcaattcatttccaaacgtcaattagggttttaaccagatagcagtgaattaaggcaatcttacgactgttaaatcatgcttgacatgacacttttataaaatgtctccttcagtttaggtgagagttttagttaagaaagtaagatttagtgatgaaatacccttcatctaatttgcagcaagacatgacactgtggttaggatcacaagagtcattcacatttctcatttttgagtggagaaaagccaagtcaattattcttcataggtagtgtgtaatttaaaggacatgtgtggctgggcgcagttgctcatgcctgtaatcccagcactttgggaatctgaggtgggcagatcacctgaggtcaggagttcaagaccaagctggccaacgtggggaaaccccgtctctactaagaatacaaaaattagtcaggcttaatggcgggtgcctgtaatcccaggtactagggaggctgagacaggagaattacttgaacctgggaggcggaggttgcagtgagccaagatcgtgccactgcactacagcctggtgactgacagagcgagactctgtcttaaaaataaataaaaacaaataaataaaggacaagtgtttctcaatacacttggattttgaagtttagaaaaggaaactaatagtaaagtgaaaatcttgaaagtatcagaagcatgaatgtgatcaagtactacaataattactacttcgctcttctaacacctcatagtatcaggccaacatattgtttcatacttacgtcctatgtcgatggctttgctttacaaaatgattagccttttgcaaaagaaagaaaggaggaggtagaaaaggaagaaggaaaacacatattttatgtatgagattcagaaattttagtaaaacacaagtattaggagttgatgtgtttgatcctttatcatatacatgtacagatattctgggtgcttttcctatactggcagttttgttaggtagaaccctgagtatggggactgaggctgtggcatggccaacagtgttatttactttttccatggtccatcactaccagtcacattcttaagacttggcttattaactgtagtcataagcccacagcttgtagttaatagcctacttatcagacagagcctgcagtaaagaagatatctgactcaacatttgttgggggattgtatgcagatttataacaataatagttacatgcaaactgttgtcattgcttagcctttaacaccaaaaaaaaattacagacctttcttatgtctcctaattgaagggcgtgagagagctggccctgagagagttcactgtctaatgtctgatctctacacctatcacttttatcgtaatttttgtaacaactttgtgagacaaatatgctcctattctctcagaggaggaaaattatccagcaatgctaggtgatttattgaagtcatatgtgaggttggacccatgactctgagcctcacacgcttttcttagcatcactgcctctggtaacagatggcttccttccatgatggcggcagtaacctcaaagagggataagacaatgcctttcatttagactcaatgcgcaattgatgtgtattttaaacatttcactatatcaatatcctgttagttttcgtaatactcttctgtagttcaacatatatccttggtggagaaatgcttaatttaggataacccttgtaaaaacgctttccccaattttcccacggtagcaagttggatagtttttgctctgtgaatgtgtgtgtgatgaaacaaaatactagtactgatgttgcaaatgaaataatctaagcacatgttttccaagtagaaaaaaacaggagattaaaaaatcacagcatataatattgaatttggtggtgactcaagttagtgccgttaaagaatctataatcgattgttcctaaccacaaaaaatacattgtgacactgcaaaagctgctgaagtatgagaggtaaaaattacttgaaagtcaaaaaaaaactgatagaatttatttcaatagcttgtaatcggttttatatttatagtcattaaaggtctaggaaaattactattaggcagtaaaaatttataatatttatggagaaaattatgagctacttggtagtcacaaatttgggggtttaaaaacatcttgatacataacagccatgaacattaaggatgtgttttatgattggactttattgtccaatataattgagcaactggcctaaaaactctgtatgtgggaaaggacagtaaccattatatctactttgagcagagtttaatagttattgattgggatataatttaataaatatgttaagtcacaggttagaccttggattatatacaagatcatttatttattagttgtctgacctcaggtaggtcaccagagtttactcggcttgatttgctttatgcaatggatggattaattggatagattaattgaggattaaatgttttaatataaatctagaatataagatactcaacgatataaatctattgtagagcaacacaaacatttattaagattagagggaaactctagatcttaagataatttggctcagaatatcaattcaaacatacccagcactgcaatatgtcatcacattctgagatgatttaatcttagaaaaaggtttataaggcttgtagtctaataagcttgtatacacacctgagtgcacgcacgcacgtaagatgttcttatgtttaaaatgttgaatagcaaaatcatatgcatttattacagacttaagtgttataatgtcggctttaggacgtaaaagtctcttgatattagaatgtaagatattcactcaatcaacaaatattattgagtatcactcaaagcgatacacagatttcaacactggggcagaacacagaccaaagcgataaaatcccggccctcttgggattcatacgtttgtgagggaaaaaaggaaggagtgagtgatgaaacacttagtgggtcgcattgtgatatgctatgtagaagcaggacggcagaggatggggtgggtcaagcaagaggaaggggctgaggctgtacatcagatggtgagaacgaacttcactaagaagatggcctttaagcagctggagaagaggagtgaactatgagggcatctggggaagagccttcatgcagtggaaacaggtcctgtaaggtgctgaggatggggaatgctgggtaagtgtgagaaataagaggaaaaaagctacagtagaattatatgaagacaaaatgttctttctttggtaagtgcttgttggtgattgtgggtcttctgtaaggttgttgaaaagataatgagtgattgtggtaggtatgatctagcttgtgatctaagagaatcttagggctgctttgttgatgatggcacaaaagtggataagaaagaagcacattggactcattcaggtgatagataatggtggctcaagccactgaagaatgaggtggggaggattgctcagcatctcagcgtcttttgagtaggactagccaaattggccaatgtgctgatttggtatttgacagaaaaggaggaatacaagttgactccgggtttttgtcctgcccaaatagaaaaagggagttattctctagcaagctgggaagactgtgtggaaaagcacacttgggagtgcatcaggaatcaggtttgggaaagcttagtctgatatcccaggtggttgagaagacagtcggatatatgtgtctcaatttcatggaaaagtccaggttcgcgctttaaaatcaggggtcctggcttggctcagtggctcactcctgtaatcccagcacttttggagaccgaggcagtcaggagttcaagaccagcctggccaacttggggaaagccggtctctactaaaaatacaaaaattagctgggcacagtggtgcacatgaagtcccagctacttgggatgcagaagcaggagaatcttttgaacccaggaggcagaggttgcattgagctaagatcccaccactgcactccagcctgggtgacagaggtagactccatctcaagaaaaaagaaataataaatgaataaaataaaacaatcgatagtcatctgcaaatgggtgagactggaaaaagttacttgggaagtgagggtaggaaaaaaaaaaaaaaaagatctgacagagaagagaattgccaaggatactaaaagtacagccagtgggttgtagaagagccaagatacagggttgactggaagaccagagacagttgggggaggatacagtggaagctgtgtggtgctgctttcaggtgacctgagatgagtgtaggtgctgctgcttaaattcagcaaaatatggggcatagataaccttgacatgagcggtttcagaggaaaactggaaaggaaaatgggagggaggaattagagacagagaataaaacacctatttcaaagagttttactgccagggccagcagcaccagggcctgtgactggaaaggatgacaggaaggcaaatatttttacagtgaagggaatgatacagcagccaaggaaacctggatgtgggattgcatgcagggtggagggggtgtttccttctgtggcatttaatgcaggatggagggtatgtctcctgttacggggttgaatgaaggatagagagtgtgtctcctggtgtggggtttaatgcaagttagagggcgtgcttcctggtgtgggatttaatgtggggtggagggtatgtctccaggtgtggggtttaatgtaggatggagggcgtgtctcctggtgtgggattgaatgcaggatggagggtgtgtgtctaggtgtgggatttaatgtggggtggagggtgtgtctccaagtgtggggttgaatgtaggatggaggctgtgtctcctggtgtggggtttaatgcaggatggagagtatgtctcctggtgtggggttgactgtaggatggagggtgtgtctcctggtttgggattgaatgcaggatggagggtgtgtctccaggtgtgggagttaatgtggggtggagggtgtgtctccaggtgtggggtttaatgtaggatggaggctgtgtctgccaggaggatcactggcaatgattggtaggaagaaggccgagtgtctgactgaatgtgcagggaatcctgaggtcgggggctgtgggacttctcttctgaataattatgcttcctggcacccctgcttctcagttaggtctataatgtgtggatttaatgcgctcctccagcctcaagggcacaggactcctcagaaacttttcttgttctgaatgtcatacactaggctttgaccatagggttcttataatggaagacaacagggttcttataagtggatagaatagggttcttaaaatgttagacaatagacctcttattaggacaggcaggggtggtgagtggtgggagaggccacgacagcccccaaggcagaccgaggggatatgtggtcgccatcttgctcgtccatgttgctaatgaggttaatgattctcatcgggtcatgcagtactttcagtttgacttaaacgtccctcagcaaccatgagggcaggcaaagaggcagcctgagtgctttctgggctaaaaaacccttctcttgggggcgatttccttcccagaaaagacctcaggcatgcgtcatttattatttcaccttcagagtcgttcagtcttagagttgatacagacccatctcacctgcagagataatgacgggatttaccccctttagttttcagaactgtgcttctccaaactaaagtaaaactgttaagcagccttatgaaataaaaacagaaagtgacaacaacaacaaaaaatcctttacgttcaaatatgtatttcttattcccaaactaaagacagggggagactacatgcatttgcatttgcatttcaacaacccaactttactcttgcactaatggggcagagtttttgtttttttcttaaattcaatttaaagctcagtgccaggttaactgattattaaaaactcatttttttttcttttttaaagaggacgtaaaatttttaaaggaatacatttactaatttctatgattatactgtaattattttgtttaatgaagtaattgatgttatagaatatcaatgcagaaaaatacagcccttttaataagttattagttttttcaacttatggtatccatgattttttaggatcaaggctaattgttttgactcattataggttctgttactgcaaagtcctgtaaaatttctaaattgcaagtattttaattctttgctgtttttgtgtgctgaattaattctgcatgttatgttttatttctgcatcttttcagagagggttgtaattgtatatgcaaaatggtatgtcagataaatacatttttaagtagagtatttgatggtctctaattcttttttgaatgtcaacaactattttatccaaatacccaaatacttttgaaggtgttaatacactattttactttttgtttttgctgggatcctttcaaggtaaagagtggttagtaaaatgatctcctttaagttgctaagagtaagatgccaagtaacagaaaaatgaaactctcatgctagcaagtgtgtatgtgtgttggcgtgtgtgtgtgtgtgtgtgtgtgtgtgtgtgtgtgtgtgtccgcctgtcagctctaaccttccagcttacttgagtaggtaaaactaaatattcatgggaaaatttattttaacatacctcttgaacttgaatctatcaaataactcaacatgaaattcacattcaaataaattctaccaaataagaaattattagacaattataattaattacaatcttaatagaagaatccaaatatatgcacagttaaaactttcatttaggctgatcatattgtgccactttacatctaagaatgtcatgcaataaaatattaatttcactctgaatagatttgaatagattggccccattgaaacctttactcagaagccgccatgttgtggcaatttgtcaggataacatccttgcctggtgagacagtttcctaaggcatcaccactttcctgcttttaatttctctggttatgatgcagatcagacaggaaaatggacaacagcatatttcctcccaaataaaaatgtgatgtatttaggctcttaacagccatgctaaggaagaagaaaaaatagaggcaaaaaggaataaaaaaaaaaaaaaaagtgatgagttgctttatataaacttgaagcattttgtattttattgttatttctaaacaaatactcatcagaataatgtatgaaaatgttcttatctagaggcttacgaactagaaattcatgagaaacacgatgtatattgttaattacatattttaggtggaaattaaaataacatcaagtctcgatgattcagaaaagaaagtttaaaacatgattaaataatatttttttctattttgaagaaaatgatggtttgtcattgattctcctttcactagccgtctctggtttatggaggtgtgcgctgagttgccatgtgtcctgaaatagtacaatgaagttgccctgacatgaacaaataaaatgaatttcaggatttttctttttttgaggtggagtctcactctgttccccaggctggagtgcagtggtgtgatgtcagctcactgcaacctctgcctctagggttcaagcgattgtcttgcctcagcctccccaatagctgggatttcaggtgcacggcaccacgcccaactaattttttttaattttattagtgatggggtttcacaatattgggaaggctggcctttggactcctgacctcaaatgatccacctgccttggtatcccaaagtgctgggatgacaggcgtgagccacagcgccctatatatcctcccatgatgaggaatattatgaacacacattttaacattttaagagttttgagtactacaggttaatactatggggagaatgcaccaaaagctagggaggaaaaaagaagctatattagtaattcatctccatgcatctgaaattgagcagtggggaattctatccacttatctccctcttcactatggatgaaaattcagtctgaagtcataacctttgcaaagtggtggaactccggaggcaccactgaagcaccgtgggacttcctcttcccttgagttcctagccgggtaacttaggcgaagagggcatttagtagacactgaactgagagtgtagatgggtcagagcaactattccccaacctggcctctgagaataagctttaaaagatttcctaggtgtatttaaatatgactttctgaagttgaattggcatcaaaatatgtgctgttgcgcaacatcgtacatgtacctaaggctgccaaaatgtgctcttggactggttaaaatatcttaatgttttgtatattttaccacaattatggaaaaacgtgtgcaagcattttcaaattattttttttttctgaaaaaggcctttttaggacttggatcacaaacgctttgcataactttcacttgtctatagttttgtgattatgtgtagtaagcgaaacaaagttaagtgtcctcatggtatgttcagttactcttagcctggcaaaatcctcaggtcagttccatcagcctttagccctgtttgagtagggttacgtatgcatgttttgttaaaataacgtacccgggatacgagtttgggtttaaagaattttactagaaaggctctcaaaagtggttggactagtatgttcaagcacaaaggacccctggatgttattaaccgtctggaagagaaatagtgataagcattttaattttccatgcaggacttttagggacctttacatgttcattatcagtctcaacaaaaaaagaaaacagtttcactggttgttattggccaaggggctttttaatttgcatcagactaggtcacctttgctagaaatattctgagaatctgacccaaattcctcatttttcagataacaaaaaaatattcaggctctggaagtcaaatgatttttccaagagcacagacagactggggtttaactcgctgagtcctggctgctaatctattctttcccatggtcaatcaacctgctttgatgaacattcaggtgacacaggtcctgccttgcaggccagctctcctggtggttattaacgagcagtggtgtggtagattacgccctgtgcaatcatctctaccaattatccttcccagccatggcatggtctgggccagcagtcagcctattcgtcacgtatccctggcgatgacgccctttcctgcttaccttggcggcagctgaatttacttgatggatggactacaggtaggagtttaaattgttctgagacaacagtgttcttcagagtccccacgagtgtgcaggtgaatttcgaggcaaaaagtctggatgctcagaatgtcagttgatagaaaaagataaatgttcaagaagcaaagatttcatttgtggcttttctcggggtgcagaagtgacttttattaactcccggaggctcctctgggtggcgttgccctcctttccccaaggtcttactgagccacttgctactacagatgctcagggcagggcgggagggaaccagctgtttaggcagctctccaatgtccaatgtaggaagcctgttgtcagttcttcttattattatgtttttgtctatttatttgctttaatctaacttcagcttctcaaagcccaaattattttttttttaagaaatgtctttttaggacttggattataaacgctttgcataactttcacttgcccatagttttgtggttatgtctagtgatcaaaacaaattaattgtcctcatggtattttcagcgactcttagtctggcaaaatcctcaggtcagctcaaccagcccttaatgatgactcggtgagctaaactataacctccatctgggcagaaagagtgtttgaccactttttatcacctacagaagcgaaccagatagaggcataactgaatagttgtgttactgaatttggcatctgccgtcacattgattcagaaatttaaatgacagttcttgatttgtgggagcagccaggcttcggacaatcagatttttaaagtaatagcctttaacctttttctgtacttctgtggtttttatgttttcttgattatttaacaataataatattaacaactatattattgactgacttactgagaacatatgacggaccaggtactacacaatgcacaaagacctcactttacagaataagatggaagcttcttattctgtttacagaataagatggaagcttcttattctgtttacagaataagactgaggcaaaacactgatacctactgtatcccccaagttttccaaattgcctaaaaattaaaagcaatacctgggaaaatcataactgggaaaagattagctgacccatcataactttctgcgtgttacaggaatcttgattcaattatctggtagagcttgtgagtgtagacacagaaggggttttgagatggtggtaaggctctgtgaaggttctcttctacttgcttctgttttttttttttgttggtttgatctttcttccactaatggcttttctaagtcattgatggcctttgatgtcttctcatactctagagaactaaaatgtacaggtttatgtggtgtagggacagaccgttgggtggacagcttcctccattgcagatggatgtgctggacagtgttgttactggttccttgccttagcttctctaggcattttctctggtctggtgaatttcctctgctaagaattctctaatatccttcctgagtgtaataagaattcctgtaagaattctcagagccaagtaggaaaaggagatttggaggtccacctttcagaatgtatattttcttttaatctcaatgtaggctagcccagcatcccatagtctaattgagcatctctggagagaaagcctccagtctattgctggaatgtgggaatggcagtgcctctcctgtcaagtaggggatggtgtcaggggatgtgaaattgtcttattcactattctcagaggtcttttttttggagcactgttttcacatgttttgacacacatctgaggcctcctgctcttgagccttcctgggattctgtgctgcaaattggcttgtttcacgaattcccaaattacccatttaaatttcagctttatcaattctgctaagtcagttccagttgtctgttaacccagtagcttctcaagttttgctgctgtcaatgtgttgtttttttttttttttctcactttccttgtagagatgggcttctttgtgcctttgaaacattttgtgagcaagaagtggtaagtccatgagtgtattcaatatgccatgtttaactgaaaattctccagagcaggtgttgatacatttcatacatttcattttatatatgttgtatttgaaatatttatggggcagagactaaagccagattgaaatgcagaatcacggatggagcttcagtgatattcctccgctctttacatttctattctctgtcttgtccgttgtattcctctcttgtttaaatgaagtgatttccccaaactaaagtttgggtttttcgctcatgggaaaagctggacaatcactggcctcctcctgcgggcacatggcatggcagaggagagcaccccaagggctcctctgggcgcctgcgcactcaaccgtgtggtgtgaactgtgcacacacatgttctatcaggaagcctacttattcctcccacatccagtcccaaatcttcttacttgttaccccaagctacttttcctcttgtagttctcactcagccccatggtgtcttacctgagctgcgttcggtgcgttataaggatttcttgggtggccccatattctccaccctgtttctctgtctttctcatcccagctagtgaattgctcaatgcatgcacctgggaaatgttcttgatcttccctttccttcttttgctaagccatcttcaaattgtgttgattccacctccaaaatataccactggtccttcctctcacatggacccttatcactctaggaaaagccacaattatttcacacaaaacctaaaattgtttagtaatgtctccatgtttccactcttgcactaggattagatatttcttacacaaagtgatgttttaaaattaatgcatgaggtcttctcactgccctgacctctaatgccatcccatggacgtcgcatactgctaaacactaaccgttgtctagaggcctctgtgggtcctcctcatggtgtggtcctctttcctgctgttgtacatgctaacctccttctcacgcttcaaatttccagtcaaataaccttgtcaggaaggcctcactgacaagtatctctaagttatcttgagactgggcatggtggctcacgcctctaatcccggcactctgagaggcgaaggcgagcacatcacctgacgtcaggagttcaagacgagcttggccgacatggcaaaaccctgtctctactgaaaatacaaaaaatcagctgggcatggtggcacgtgcctgtaatcacaggtactcgggaggctgaggcacgagaattgcttaaacctgagaggcagaggttgtagtcagcctagatcgcaccactgcactccagcctgggtgacagagtgagactccatttcaaaaaaaaagcattaaaaaatttttaaaaaattatcttgagtgattctctccatcatattacaagtacatcgtttccacctggtattaattcgagattttgtctttctatgcactccccactacaataaaagtaacttacagataattagctctactaagtaagacattaatacataatggctatctggtgacattaaaaatattattttcaggaaaagaagtcattcaaaccaagttacattgtgaagacagtccccaaaataatatttaaactcttgacttgtgtagcagtattatccaaatgatctcactcttcattagtgaacaaagatttgcttaaagtgatatagtgttttttgggttggagccaaccgtagaaattgagaccaataatttttaagttttttttttaacataagcataaatgtttaagtcacgtttgcggtgttcacgagaaatgttgggaacacccaagagacggaaggaaattcaggactagagttcaagagagaggttcgggtatgaattatgatcagagcccaattaccatggaggctctgtaattaattttataaatatttattgagcacttactctgtgccagggggatgtgcccaattccagctcaagttacgaaagtgaatgaaattactgagagagaagaaaagacctgcatttgaactgaaagaaataatcacatatttgtaaagtggtaactatatttagcagatggagtggtaaaagagggtgaaaaaataattttacagcagaaattctgcagaacacgggaggggagatgggaacacaacaccaggtgctacaaaaagggcacagatgaaaggaggctgggtctgatcatttaccctgggtgttagaggaacaggaaaagtgatagagtagacggtgtacctctaacgtatgaccattttagtgggaaatgacacaaagtgtgacttgaggataatttgtgtaattgctgtacaccgggagtatttgattagacatacgttggaaaaaatagcattgctcagagaatgaccccaagggttcagatccaaaatggaaagatcatatatttgatttttgctatgaaaataggaggtgatgtctcaggaaaagtataggggaaataattgtcagaataaaaggattgacactgagaaaacagaagttaagtctgtatattgttacaggaccaaatcaagagactgatgaaaacagccaggtttgtattgaaaccagtcaccatcactgtaatggttgcctctatttgaagagatgtatccaagctttagagcctaaccactgtcccactaatactgaaatcactgtcggtatgaaacagtatatgattttattgaaattaagcaactgtaaaattaatcattattacagagaacatagacaacttgactcagaaacaaattcaaatgtgagtttagaggcataaatgcaaatattatttattagaaaaagatcatacagcaagtggaggttgagactttcatggaaaatatgaagcatggcagaataaaagtaggtatataatataaaggtcattttcgagttgagatagagaaaagtttaaagaaaatcattagaaatgaccaaacaaaatcaacagtttgaatattctgcattaatgaataggctaagaattcacagtataggaaagtcaaacttggatgtattgctattgtcacacgcaattcagataaattgctacatccctgggatactcataaaatgaaatgagcaaagtgccaacaagagtgattaggaatttataactagtgttccattactagaacgttcagcatgtaggagttacttataccctgctgttcaaggtcatcgccaatgtccgattgcaaaaattcaaaaaattgcaacctcaggcatcagtgggttaataagccactgccagaaacccatcagtaaagcataggttttctttttgtgaggttggatatttcttcttcactgtttcccaccaactaccatggcattacctggagcctctgcacatttctttgctcctgaatcttgttcttcttctttgcatagtctcatctgaaaccacctcctcttatgtttcctttctggctcaccttttcacattttctttttgcatttgaatcttacttgagagggtgatcgacctcatactctgtggtctcttagcccaacaatcctgccctaaatgttccagtatcctataacaccgtagagtatagaagtcatacagttgtatttcctaaaactttaaattcagacaacaaaattagctcctaatttttttttttttctgatgaggtcaactgagtcaactttttcaacagtttctcaaaagataacttgcctgttcaccaaatggtttcccttcaagctcacacctttgctgcgtaaagccttccttattcaagaagacacttccaccaccaccttctccctccccttgatgccagggacgagtcatgtgacccttacctgtgtttaattcactgtgtatagctatggtataacgtgtcttatatcaccattataaaatgtgtcaaactatattagagttatatttcatgaaatgaagttccctaatattagagaaaatatagttgattgttagagtccaaggcagcacctggcacacaggggattcacagtgcttgcatggacacttggcttatatgaaagacttctgcaaattctaaatcccatatctagatagaagcatttttatatcaagaagagtaattgttgctagctataactttgcatgataagcagcggcatgaaaagtattcagtagttatttctgggcttttctacaaagtactatgtagactagcactacaccaactaaaatgtcagcccctatctactatattgtataacagacacaggacactacctgatttaatgcattagcatcaaagacttatcctttaagagacacaagacaattctagttagagaagtcttaaccgtggggacctatcctaggacagccattttgaaaaaaggtttgttggagctgttggcttttgaaagggatgctggaaatcaaaactgggcaagaaaagaaggaaaaaagggagactgtcaagctggtgtgggtctgacaccccatcctcatgtttacctctttcttgtgttggaattctgtgtgtaatttcatctggagactttctcttttctgtaaagagaatggtaattttaaaggtcttaaaacatctccattcgtttataccccctcctcctagatgactggtgcttacatgaaacatgagaagcttcccttcactcagtcatttacgaaagaacacagggctgtgaggcccagcattcacacttcacggtgtcctcagcaccttccatctggagggctccgttggcagtggcagcagactcaggccgggttctttgatcttgagaattcttagtcccgtgggggtactgaataagcactaattctattaatgagtaaaattttactaattactaatttaacaagctttacttacttacttaggaacttcaaataagtattaattttaccatgcacacaatagtacacactattctgatggtgtgtgcaccatgttaaaagtgatgagatcaagggaactgaaagcatccctgcagttactgaggtgacagatagaattgactaggcaaccacagggagaaggtcaggtctcgtagagtgaaaggattccaggcagaaaaaaagggcatgtgcaggaacagggaaggaagaaggccatcgcaatgttgacaaagccacaagtgtcataggctggtcctgtcctgtgaaaaaatgggattacataaaaaaggcaggtggcagccagattgagaagaggactgcatgccaagaaatagcatagtgacctccctttcttcccataggctggcgtgggtgtgcagctgtcaggaagttagaggactggctatttgtggctgaaatgggcaccactctctgagtttaagtctggataaaaatgccaacaaaagaaactggcatgttcagtcctgcatgaatccacgttctctttgttcttgtttaatttttttgtccctgctttattcttaacatcatagaattaatcacataaaccctgccttttccatgcactgtgttctttgaaatgttagtgccagaaaaggagagaatagatattccaccaagaaaacaatgttttaaagaaaaagtgacaggaagtattactcatgaagattcacatgtacatttgagttttaaagaatctgcatattaaagtctgtgtttttagaaaacctcatttaaaattattttcaattcttgtatgatccaaatttatgttcaaagtaaacatgtttttgcatatttcatgtataaattttagggaaaaaatgcctgatctatgattatcagaacaatgtaaaggatcctggtctctggaagaaaaaaaaaaaactctctatgtattcataaaaccccggcccccaaattcttttctcagtgtaaaatattcaggaagcattgagtcttttgtgttactaatgattcagacatggtatctttgcctgaatctgttattcatgttctatctaaaatttttgcaagaaaggaagtgccatctgtggacatctaaaagccaaatgtaactattgggtggtggggagggaggagatgaatattatgaaaagtacagcatttggctatgaacaggagaaaagcacatctctgatcaagaatttctacctagaggtcgcagctggttaagcctttatgccgtggacacaaggtccctatcagcccctgtttgggatgcgtcccctctccctaggttggcaccctgagaactgagacctattcacttgtccggaatagaagcattgtttgtatttcgttggttccatggctttctctgagccagcttggaagaaatcattaaaactgaggcagaattgaacttgactttctcagtaatcctgacagagtaagctgtgcctgtatctcacgtgaagtgagcttcgtttgtgctcattaaaagtgagctgaaaacaaaaacaagttgtaaaacttaaaaaagaatatacatttttttaaaaaaacgctatctaaacctggtggtcatagtttttttatttcaaatttgttcgtatttttgagcttctcttaaagttatactacatttgaaatgtgcatcacagcatttagaggaaatatgtcaaatatgggaatatgtagttctctgtgatgaactcttgcctatatccacgttagctacacacacaccaaacacactcatactcatacacacacacatacacgtgcatgcaaatacatactcagtgtttctgttcaaaattctaataaggtgggccaggcacagtggctcatgcctgtaattccagcactttgggaggccaagtcagacagactgcatgagctcaggggtttgagaccaacctgggcaacagaggaagaccctttcactaccaaaaatacaaacattagccaagtgtggtggtgcatgcctgcagtctcagctacttagaagcctgaggcatttgaatcgattgaatccaggaggcagaggttgcagtgagccaagatcgcaccactgcactccagcctcagtgacagagtgagaccttttctcaaataataaaactaatactattactactaattttaataaggtaaaattttcttgtaaaagtctcaaacatttcaaggcttacttccattttagtccattcatttaatttccatctattgagccgtatcctatgtaaagatgtgctaaattaaaatacaaagtagagatccaagaactaagccaaaacaaaacaaacaaaaaaactggaatgaaattgagggagtaagatgctggataattcagtaggtcagatatttattgatcattttgcattttcctttttgtccattgttacttacatcgtcagaactttgcccctttctgtttgtgtgccttgaaagacaccatgtgttaaatgcactgtggttacatagtcgtatgctagtgtctaattaatgagtcatccctccattcattcattagtatctgtaggacctcaccttcacctcatctgattctcagcctaaacactggggttcaataactgtctcttttcttatctttctcaatgcaagttagtttgcgttccaccctcaccacagctggcagggaaccccatctcagccatgttctaccccattcccaccctttcaggaaatcacacaggagcccacggcttcccaccagggagggcccatggctgctttcatctcagttgctgagcaacaatcaccctactctgcattttaaaattcattaaaaacagaaagctgacatttgatttttctttcacgttgcaagtgggagagcaaaagtgttttatttctagacgttgtgtgtctgtcatttctacattaacgcaccaccaaattttatttagcaagtgtttttcattctagtaactggccagtatccgggcaactgttcctgttctcacatattagctattaccataagcactaccagcagtgattaggatggattgaagcatgtaaatttcaaagaatagcctttttttgtgcacggcccttgagaaactctctgaattgcatgtctggagcagagaggtgtggtgtgagcagagctgctcattagacctgacaggaccccgcctcacttgctgacagaatggagccacccagctggttcatagacaacaagtacccattagtgaaatatgattcacattctcaactatgtctctccccatttggtttatatcctagtaagaaattttccagatgttgtctttgagtctaagcatgctccactgggtgaagcatctatattcttccatcttagacattagctcaaagtgaccttagagtgggtcttaaattagtaactcagttttaaaaataagaaaacaaagactgagaggcaacatgacttggaagccaacgctaggtgttaggtcttcagtgggtatgagggaaggaaagctagttgggaatgagaagaagtgtcttctttccagctcagcctctaaactgttgtcctcatcttcctgtaggatggaaagctggactagaagggtgtttcccaaatgccagtccatgaactggctggtaaaagcaatgagattgttcaatagcttgtaaaaaaaaaaaaaaaaaaaaaaaaagaataaggccgctgttgtaaacttttcacaatgtttcatattcatgtatgtggttacatataactaattatttctgttcttagatttttaaaaattgtactttactgataacatggtggcagtagtagacaggatcattgtttagataactaccacctactgacaatgtcaggccttgatcaactattctttattttagaaaaaaaaaggctacaaatttcaaaattttataatgtctaatctaaataagctttaggatcgcttccatctgccagtctgaaaggacaaatgttaagtacatttttcatgattttctgaactacctgggacgttaatgtcaaaacatgaaaagtatggctttcatcttagtgagattctctatgtgtaaagccttttaattggtgggattttcttcaagttacctgtagatacatatttgggtggtaggtatctagttttgactaagtttgtagaatagtatttatctgagtcagtcagttaaaggatgcaaaattagctaaggtataataagttaaaacaacatggagagaaaataatatatatatatatatatataaatagggaagtgacagagtcttttttatcataataaaggacacttcttctcctacatggtctttgaaatcatgacttttacgttccgttgacaaggcatattctttcttacagttgaaaaggaattattaaggtccttttattgcattacagctgcacaaatgcaagtttcaactgctattttataacagaagacatactgctaaaaatgtctctaagataggaatacagttgactttattaccctttcttcctaatagtacattgatgatgttggaagaatgttttctgtagatatgatgttgggttattaaagcaagttagtgttttctcaccctcaaagactcctactgaaaaattatcatctaaagtccagaagtatgtaaaaacagtttgaagaaaatagtttgtgaaggaggttgacatttgcagggctctttgtcaactccccacttgcaaagtcaggttgcttcatgttcaacttgcctaaagtctgcatttcagctaaggatactgccatatttacagattttagtacgatgggatatttactgttcttatggagcaacttggagatgacttttgccgtttcagcaaaacttctatctaatttgagtaaacatttcttggaatgctcaaaagtatacaaaagataaaactgaaaataaatacattcaaacacccagtgaaattttcaaaatgagctaaaatcttctcatttgtcatgcgtaaactgctatatgtttgtagacaaaattcagtgatgctgatttaggtaaaataattttaaatgaattgcattacttcaaagaaaaacagggaataaaagaaatgtaaagaaatttaacagttggatataatgatagcagattaaagaaaagaaccaaagaaaagggatcaatctttggatttctttcagtttcttttccccctatctgaggtgcttaatttatgccagctaaaaaaaaaaaggcaaatgactttccctgaaatacatgtacaaggatgtttttcctggataaattatttagtgattagaacacacatttcaggaatatataacagcaagaaaattcccaaaatgtaatgtacaatgatatgtgaacatgaatttcttaaggaaggaaatgtgtttgtattttaaaatatttttgaaacttttatttcattgtggttctttctgtttgtagtaattgcctgaagagattttttcatttagagaagtttaaagcagaactccagacaatcgagtttttcattaagtcaaccatttcttatagaaaatatggtctgagggaccaagaagacaacactgctgtgaaacatttctttcccgagatacatgattctttccaagactgatagtcttgagaccttgtagatatgctcgtatttactcattgaattcaaaagatctttcatatttcagtatgttgaagattttgtgatttttagtgtttaacattacaattaaatgagcaaaatgaagtggaaaattggctttcttcagataagtgtttttttttcttggctaattgtataattaatgagatattatttaattagctattgttttgctctaaacattttagaaaattggtcagatattgtgtttcctatttgtgctttcttaaaagtcaaagatgaaccaatttcacactaagatataagagaagaaaattttcctgaattattgtctgtttgcagttcaaagttagaaacttgatcttttttgtttaaaatgactgagatttatataacccaccagtttccactataaaatcctgagaagaaaaagttggatttgaatgtctcaaagttggtatcatacaacttacttgacacagcacaatcccacacttgacatggaatctaacagtagaggatgaaaatgaaagcatcaaagaaacaaacaaagagcagtcctctgcccctcctgtgagaaagtcatgcccagcatgctggcttggggagggagtgaaggagctcccacagatgggctgaggcagcatcagatttgacacacagtgacaggagaaatgctttgcccaggaaggaggaaaatgatcaggagctctcctggtacagggctggtgaggtaggaggtgggacttgactcaggaagcagggcttagacactggaccaaatagagaactagctaaaacagatctggggcagaagcagcctttcataagacacctcctccagtgtgccatgccagtttaccattgtcatagcaacacccagacgtggtcaccgctttccatggagaccacctgtcaacacagaagttaccacctacattctagaaatttctgcattaaccgctccttattttgcatgtaattgaaagtggatataaatatgagtgtagaacagcctctgagctgccactctgggcacatggcctatggtgtagtcctgctgtgctaggagcaggacatctggtgctgcttcagtcaataaaagttgctgtgtgacaccactggcttgcccttgatttccttcctgggtgaagccaacaaccctcccaggctaagccccaattcgggggcttgtctttcctgcatcacggggacagggaaaaggaaaggcaggtggacaaatgccagaagaggcagcatggcagcaaggaatctcacgcggctcctgtttcccagagaggaggggccatgggagtgaggttaagggaagtgttcgggaactagcagatgtgacaatgtcctcacttggcttgatgaggagttcacacctcatacaattccacaggaaccctggagagtcttcggcatcagaaggatgggaatctatgtgtcctttggaattctttctgtccctgtgagtttgagggaagatgtctcatagatgggaaccactgaagagcaagctgtgaaatgaaggaaagaggccagctggctgcctctttttcgtttagaaatctgggcaagtgtctttttaaaagtgttgaaaaggtgagcgataaagccacctacatctggaaagaaccttgggctctagggcagattttggttttagatagaaatcatgaagatgtgttaacactgtaaatcatcagcgagcaagggtgaagagaggacaaaaaaagaaaaattcaagaagcaagaagtcagagacaggagagaatacaattggattcattatggttcacggcataagcagaaagcagctttcactggtaggtttttcagctctaaattgcgtactgcaaagggtcaagtttttatctgttatgtctacagggcatatataaaaagaaatttaagaaaatctcacactccctggtattttgaatggatacttattgctacctcaattttccaaccagatattaaacaactgtaaaaccggacagttttctagatgttcttcttctgatttctgtaatacaaaatttccacgacaatatattctccatattccatgctttttattgccttaattctgctatatttttaatcatttcttgactcatcatgatgttttgcataattggttttatgtcattctactgcatatcacggccttagttttatgactctatattcattttcttaacattaatttcagtaggaaaaagaaaatagaatgagtcaagtcaatctgatattgaagtttaaaaatataatctgttcttatggtatatcacagattaataaactacagaacgcagatgaatagaaacatcaattatcaattttttatagccaaagaaattttgaaaaaccataatagagttttcataacatggtaattataataggccagtaactcaattccttggggaaatgcttccctcttactccaggaaggattcaaataagacctgatttgcttttatttcttctccagtctttttttctaattcttcttgtttcttgtcctctgtgtatttgaccgagaaggcaattataacaggagcagttacctttcaaagcaagaagaaatatctgtgttccatagctgagtctattttcatttctaacaccttagcctccacaatatgtttggatatgttttattaagaaaatcatcatgtgtatgaaattgcttgtcctgatattgcattaaatagatagtaaacacatatctgaacaaaagtgaattaccctcatatatttacatattctcctactgttggacttttaggttttaaacttttctctgcttaactatttcatgctataatgaatattgcctaaagataaattcttaggcatggaagaaatagactatttaatataaatatagttatgtttgttgctccatgaggactaatttctccacctatatggaaccaattatcactgacatcaccagggctgaggttgcatctgtttcaacataattattgtaacttttgctattgccagttctaatggtttgctatcctagtagattatcgaaatgttacagtatctactgttattttgctattaatacactcatcagaaaaatgtttcttttgaaatgtacatgtgaatgcacactaatttatgtaggaatacataaacaaccccctcttcataatgaaaatgttgccagtcttactgaattgaatattaaacctaatatttcagtttcattcattttcttaacattattttctattgatggacatttgaaactaaaacttcagtttaagaaatattaattttaaatgaataagacattttaatcggctatttaaaattttagatatggttcaattaaatgactgtaaaatagttggttgaagacaaaatatgatttgcttattaaaatcttccatgagtgtgtgaatttatctaaactattaagctaatttgttgctagtcagataattacgagtcctagccactaaaagttaacgttaacatggtttagaccagccataattgtacagtttcattctgtcacttgaaataatgggaatgctggctatatttgcatgttatacaacttttcacattcatttcctatctacgtcaacttgtaatcttatacttattactatacctataaattatcctatttttaccaactgtcctatttttaagactatttagaaaatgagaaaacactttaattttctggcattcataatacacctcttgcaaatgtaaatagaaaaataggtatacacatttaaagaggaatatgtgatcttatctactaaaacatttttatagatttataattttatccacatctatatgaaataggcattttatccattcaaagaggagggcaatttgcccaactctaaattataaaatatttagtttctgaactatggaaaaataatattgtattaaaacaatttgcttctaggagcccacaaaataatcactcaaaagtcataaatattagaacaatctttatataatcaactaccatttaaagaaatgatatggtttcattggaaatattctgaaatcctctagaaatactatttgacccagccatcccattacagggtatatacccaaaggattttagatcatgctgctgtaaagacacatgcacacatacgtttattgcatcactgttcacagtagcaaagcttggaaccaacccagatgtccatcaatgatagactggattaagaaaatgtggcacatatacaccatggaatactaggcagccataaaaaaggatgagttcatgtcctttgtagggacatggacgaagctggaaaccattattctgagcaaactatcacaaggacagaaaaccaaacaccgcatgttctcagtcataggtgggaactgaacagttggagacagggtggggaatatgacataccggggcctgtggtgggttggggggaggggaaagggatagcatcaggagatatacctaatgtaaatgacaagttaatgggtgcagcacaccaacatggcacatgtatacatatgtaacaaacctgccccttgtgcacatgtactctagaacttaaagtatttaaaaaaagaaaaagaaatcctcatttttcagcatgtatttccatatattctgaataatagccagggaaaaggtaaaataccctccctatccttttccctgcgttgtttatcctatttactcactttctgtcctttgaattgggaagaatggatccagggaagatttatggcatggatggggaggaactatgtagtttctgaagaaagagaaagaaaattcctgaagtagagagaatggaaacgtgtgaaaaagaaggtagcaagtaacttgggagtcagaaaaacgtggctgcaggaggactcggtactgattttctgcacagtgcataataggaagttcattttctgttttttgatgtttatttgtactcatatgttaatgggggagaattttccatttttacccccacaaatatctaacacaggcatctatttcttctatggcccaaacagctgttcatctcacagtggcctaggaagtgagctgaaataaacctctattatttggtaggaagaaactttgtaaaaatttcccaaatgagccacaacagccgttacaatgagaggctttctcactctgtgtggctcctgggtggaaattgtcagggcttcatcctaccccatcatttatatgctgtgtcacttcagtgagttccgtcaactttcaatgtcagtttcatcatccataaaatgaaataaagatagttacctcgagtggcttgtttgtagaactaaattgcttttgtaagtatataaatgggcgcatcatgaaataaatatcagtttggtgatactaaaaagagatgaggcacatgccaaggctaaaaaattgttcacactttttcccttgtgacatttatctcaatcattaaatacttattttagaatatctgagtaaataacaataatctttttcaaggaactattgtaaaaactatatgagcagcaaaaatatgatataatgtaggtgatatttgaaatagagttctaccaaagagaaatgtgcaatgctattatttaaatcagatgtttcttcacccagttttctctctaagaacaatttcattcaacagagttgagataaatgtgtttatgttaaatcatgtttctttttaaagcatttgatgtttacagtaaactctgtggcattgttatgaaaaaaatagaggtaaattactcttgcttgaatacatgagaaagaaaattggaggtaaattattcttattataataagaaaacaatttttataggccagattcagtggctcacatttgtaatcccagcactttgggaagctgagatgggaggatctttgaggacaggagttcaggaccagcctggggaatatagtgataccctgtctttgtaaaaaaaaattaaataaaagttagctgtgtgtgctgacctgtgcctgtggtctcagctactcaggaggctgaggcaggaggattgattgaggctgggaggttgaggctgcagtgagctatgatctgactgctgcattccagcctgggtgacagagtgaaactgtgtctcaaaatactactaataataatttttataaaataatttaggcttgttgcctactgtctccttacacacttttatgcaattatttttgtcagattgaatcttcctctcagtatagaaaaggtgtcataatttcttctacactttgaaaggtgaggaaataaattatggaaattgaatctggtttattttacaatctagaaagtgctgacaaaatctcaggtgttcatgaaggaaaagtggttttggaattagcttatgggttgggtttctatctttcctaatttgtagaacagatgatcaaatgatgttgtcagtttgctcacctagaagtggaaataggacatttttaaaaaactattctgattctgagaaagaaaaccaaaaacttccaaattgaggttttttttttttcctagcattgcataaatgggtattagaaaaaagaggatgttctggtgtgaaaaaccactttgaaattccatctcaggcacacagcaccacatgggcacagtcaatgaatttcaggacttgaaaactgacagatcctttaagttttaggttttgttttgtgttttgagacagagtcttgttctgtcacccaggctggagtacagtggcacaatctcagctcaccgcaacttctgcccactgggctcaagtgattctgatgcctcagtcttccgagtagctgggaccacaggcgtgcaccaccacacctggctaatttttgtattttttgtagagatgaggtttcgccatatttcccaggctggcctcaaactccttggctcaagggatccacctacctcagccttccaaaagtgctgggattacaggtatgagccatgactcctgaccaagttttagttttaatccatcctcaaattagcttatgtatatgtacatatatatgcaaatgtctatatgtatatgtgcgtgtacatatgtgtgcagatgtgtatgtgtgtgtatgtttgtgtgtgtgtgatccctacttacaaatggccaggagaggaaccaacttccaatgtgtgtagtgtccacccccagccatacatattttgagtgccacagctgctctttgattctaagtctcccagctacactgacttccaaattcacacccagctgtttaataacagaaggtacttggattcacagaaagtcttccgtttgctcatcgagaataaacatgttttcttcattatagaaagaagaaaagcacattggatttttttctggctgctgtgagatattaccacaaatgtagtggcatagaaaccacaaagatctcacctcatatttccacaggttggaaggctgatgttggcttctaacctgcagatgggtctccctgagccgaccccgtggtgttgaggggcctgtgttcttttctgaaggagtcagggcagtcttctgcaggctgccaacattcctgagcttgtggccttctttctccatcttcaaagccagcaaggttgcatctcactgacgattttttaaatgacatgtccctctgacctgagccagaaaaggttttcagcttttaagaaatgttatgacaacagggaacccacacagataactgcaagtcatctcacttgctcaaaatccttaactctcacacctgtcaaatcctctcagcaggtaaggaaacatagtcacaggttctgggaattacgatgcagacatctttggtggaggtaatcgttctcctcccacaactgcaaaaagagataaggccaacatctctcctcactccaggtgtccacacagtccatgccccttctccaggacaccctctatttctcaggtacctgcatttgatgtttcaagtttcagcttcactgccctctttttctaggtattttctgacgtttgaatcctcagttttattctctgttctatcactatcattttctccctttgtaacacttagttattaagtaaatatttgagtacttgtttgattagtgtggttctccctctttcactgaaagttttatgagtgtagctacagggttggttgtattcgagaggaaatttacaatatccaccatgatactcaaagagattgcaggaaagtaaccttttttgaatgaatacaggagtaatttgtcgaggctgatgtcctgacaaatagagttttaaatttttaagtataaaagtgcaaatttgttattgaagacctagtttaaaacttagttaaaacttacgtaatgaaacattttgtacatttccacgacctctacattcttccattcttgtgaaaaagcttaagaatgaactgttagaagaaaaaagtgtgcagaatgatacatgaagacattaaaatgccatattgtaagtgagctcttgaaaagcaaataggcagatgcttcatttttttaaagcataatcagtaacatgaataaaatcttaactgaattgtgaagataaggcataattcatcaaatagtcacatctcattttgttgcgtcattataagagtaataatactaacacagctggtcatcccacccgtcctagaaatggctgattgaaagatgttttctctagaaaaaaaaactaacaaaaaaacaaaatttactcttaaactgagaggcaagcattaagagccaacccacagcaggactgggagattccaatgtcctcgtttcttctcatccagagtataatcatcaaaatgcaagtaggattcatttttgttttctgtctcagggtttttgtggttggcttgaataaatgctattgagcatggcaaatgaatgcagcgccccccccccccaaaatttccatgtataatggtcatcactgttaattagacacaattaagatccttctataaggagcactgaagaatttgaacagcagtcgtgcaggaggttaggtacataaacctcccttcatagactctcaagagtccatgtatccaatcatcatgtttttcaaactatttttcctagctcttcattttctcacataggtataacacttgagtaaattatagaaatgaaaactttggtcaagggtaaataaaggcttatttgtattttatatttcaattttcttctacagttgttgcatatcgttttctgattttttttttttttttttttttttttttttttttttgtggagacagagtctggatctcttacctaggccggacggcagtggcgctatgtcggctcactgcaagctccgcctcccgtgttcatgccattctcctgcctcagcctcctgagtagctgggactacaggcgcccagcgccacccccggctaattttttgtatttttagtagagatggggtttcaccgtgttacccaagatggtctcgatctcctgacctcgtgatccgcccgcctcggcctcccaaagtgctgggattacaggcgtgagccactgcgcccggccctgaatttttttacttacaaccatactcaccagtattttctttgtgccatgtattggatcacctcctctgcatacacaacagtacttaatccttacagtagtcattttaattctacaaaggtatctgtaattgatatgcaaagtcactgattctctgaaaggtaagacattggcccaaggttatctaggtagaaagtagtgaatggtgtttgaattcgtctctgtagtatctcatgatgccttccacactgatatgaacggcgctgtggagaaaaagtaaactaataagacaactttctgacatttagttatggagattagaaaagacatgaatgcatatactttaaactagcttagcgtttcttaaagatgtgttattattattatcatcattattttgagacagggtttcactttgtcactcaggcgagagtgcagtggcctaacaatagttcactgaagcctccgtctccattaacaaatcctcccatctcagtcgccagagtagttgggactacagatacacacaaccatgtctggctagttttttaattgttatgttttgtagaggtgcggtcttcctaccttgcccagggtggtcttgaactcttagtctcaagaaatcctcccacctcagcctacaaagtgctgggatttcaggcatgagcctccaggcccgccaagatttataattatataaggatagcacagcaggcatttatattaatatacatttctaaataatttctcattttttacctaagtgattatctctgagattcaactttgtcacttaaaccataagagtgttgagtagacggctgtggggttattcttttaaatcaaattttcattaatttttttctgctttttaaagttgtatttcttttaaaaaatcatgctttgctaagcagactctaaacacagcataccatatctaagtgacactctaagcataattaacaaaaaaattatcctctgaaaaaaggtaattatcatcagtgtattgaatagaggaattgttttgaaatgctggccagaatttcataacataacatttaactggattttgtccaggtagttaaaaaggagcttttgcaatttcagactataatgttaaaggaaggaaatctcattcagttgttataatctcaaataacttattacataaaaatataaagaggatgatttgttgatagagctaatcattcaggattttatggcacctcaacataattttcaacaagtccagggcccttgaacttttaatagtcaccattatttatttcattcaggtctttttttctacattggttgaaactccttgtaaccgtacttcaccacaaaatgtatgacttgtcttccactaagggcctaaaaatattgtcatggtaagcccttgtaaaggaagagttttgttgctgctgttatctagtggaaacctacaaaagtcatccgattttctatctaaacagcatgttatccttgagtcttcagtttttgaaaatattttaagaggatcaaagcatctgatccctgagaaatggcactggattaacaatattaaatctggactgccttgcctgtccagcctcatacactgagcttgggttgaagtctttatttatgcaaagcaaaatgcaaggcgttgaggaggaatcaaagataaattggtttgtctgttgtccggtagctcctttggtagccgagaggattcaatactgatgatcgcttatatttaaatgaaaattgacattttacaccatattcctatttgcctttttaattggagtttctcaggaaactgagatgcaatagacttacatgacttgacagctaatgccagcaccaaatccattcttttcactccaccacactatgcatctttattaaagcatctatgtgctttagaggtagacttcagatacagacctcaaactatgaaaaagcacccatacactgcctgcatatcaatgaccatagcagaagatgtatgaatttagcgtgttcacactataggctaggtctaacctcaagaggatatttggtattgtattttttaatgtttctgaaagtaggatcatccccagtgctgtgctggatacgttctgcagtctcatacaaatatatgagaactttacggacagcagaagctcagggtgagctgggcgctggctctactacctcaggggttttgccagactgcagaggatgagagctcactgtacataggggattgaaagtgaactttgctcatttgcaaaggattacaggaggaaatgagcaacagtactgtcttaaaaaaagataaatacacacacggaaatacaaaaaaaacctgcgtggaaggaaagtaaaaatagttttaattaaattaaaaggaaggggaaatacgtgatattgttgcgctgtctctcctgagatggtactttaactttttgtgccatgacctctgttaatctagtaaagtcgatgaactcttagaatagtatttcaaaattcacatagaaagtatagattacaaagaaaaccaattatattaaaatacacttagtatccatgtagtccttggggttttaccagccccatctggaaaaggcaagctatgttgataatgggacattatccatcgatctatatgcttaaagactcattacgttaaaatcaaaggcgctgaaaaattccttgtgcacgttcctgaaagtgtcatatttctagacactttctttctcatcccccaaatccatcctagtgatttctttctcatcctctagtgatttctttctcatcccccaaatccatattttacctaaccaccacaggtatggcttatctatattgccaatctgaaaattctgaaaagtctctgtccatcacagtgtaggacaaagttcaggctcctggcttagcacacaggtccaccatgacgtactcttgtcgggcttgccagcccctgctgccacttctctggggtttaccttctgtgcttctgtaataatgagttgaggataacttaatgggatgtggtgctccgcacctctttgtatttgctaccttggactctctgcttggaatgactcccctgatcatgcttcgggactgctgatcatcatttaagactcaactcaaagaaccttctcccgtaaaacttaccttaactcagactcccagacttccctcgctttgcgctttgataatcgctgagcataaatacttcttcattgctgcagtctgtgcccccaactcttaaggaaagatagcatgttttattcattactttattcccagagtcaagccaatgaatagaagacaatgtgtacagaattactaaatgaatgaatagatgaaatggatgaagctttttttcttcttaacttttagatggagtcttactctgttgcccaggctggagtgtggtagcattatcttggctcactgcaacctctgcctcctgggttcaagcaatcctcccatatcagcctcccaagtagctgggattacaagaacgcaccaccatgcccagctaatttttgtatttttagtagagacagagcttcactatgttggccaagctggcctcaaactcctggcctcaaatgatccacctgcctcggcctcccaaaatgctgggatttcaggcatgagccaccatgtccagctggaagatgatttttattagccagggctctccaaagaaatagaaccagtgttttagttggaagaccatcaggcaagggaactctgtcttacttgacagagagtcagttttccatctactgaggccttcaagtgatgaaacggggcccacctacattacagaaggaaatctgctttactcattctaccaaatgaaatgttcatcttatgtaaaaacaccaccacagacacacccacaataatgtctgaccaaatatctgggcatcctatggccaagtcaggttgttgtataacattacccatcataatacttaatgcctaatacttctcaatttgaaaatctatctggttatacgaaattatctgtgaataactcagaattcatgatgctcttactggaaaatgctaggacttttatacacattttttgaccgtaggagaacaggtgataaccttgttgtagtttgtctgggaactgcttgaggacacactttgcattgtcttcatcttgatgtttcatttcccatagaacacaagctctcagtgaataattgttaaatttaacagaaaaggaaatattttcacattaaaaaatagaaagcgtagaatagatattgtgaggggcggtgaggctcaaatgactaaaattggagcaaagaacaaacaaattttaacatgaacaaactcttagaaatgtgggaatttaatgaagatggcggaactttcactatatgttttctatgaaggcatgtgcaggctaaatatcacccccagtgtgttcattccttaatccctggagcctgtgaataggttgctttatgggaaaaaggggtttacagataagataaagggtcttgagatagagaccatcctaattaccctggtggacctattctagctatgtgaactcttaaaagcagtagaaagaggcagaagaatgggtcacaaagattcaatgaggactggacccagcattgctggccttgaagattcacaaagaaggctatgaccccagagaatgtggtagtcttttgaggctaaaaatgaatgactcacagtttacagccagcaaggaaatgggaatgtgggccccataaatgtaacaaactggattctaaaagcacctgaatcggcattggacagattttccctaagaggcttcagaaaggactgtagcctgaaaacgccttgatttttgtctagtgaggcctgtattgaatttcagacctacagaactaaaagtaagactgtattctcttaagccgctctatttgtagtaatgtacggcagcgatagaacaaatgagcgctctgtaaactcaatgaccacaaaagagtggcttgacacagcagacgtttatttttattatttatttatttatttatttttgaaacggagtcttgctccgtcgcccaggctggagtgcagtggcgcgatctcggctccctgcaagctccacttcccgggttcaagccattctcctgcctcagtctccccagcagctgggactacaggcgcccgtcaccacgcccggctaattttttgtattttcagtagagacgaggtttcactgtgttagccaggatggtctcgatcgcatgacctcatgatccgctcacctcggtgccccaaagtgttgggattacaggcgtgagccaccgcgcccggcctggcattttttatctcatagttttctcggggtgggactgtgctgagtcctctgccgtaagtctcgcatgctatgatcaaggcgttaattccactgcctcctcatctacaggcttgagggcaggactgtgcatccaagctcattcaggttgtgtgcagaatccactacctcctggcatgagcacggagagccccgacgttttgctgtctgggggccatttccacaatttctccctgcgtggaattcttcaacacagcctctgcttcatcatgcctagaaggagcatcgataactccatccaggcaagatgcagccttatataatatcacacagtcatgacagtgacaacgctcacctctaccatatactattggtcagacgcacatcacaagtctttctcacagtcaagagcaggggatcatacagagatgtgaacaacagagggtgagactcacgaggagcacattaaggctgtactgccacactcgtcttttttaaatcatgacacagtcttgcatcggtgggtcaaacagattttataattttaaaaaatgttatagaagatccaatttgttagggtgatttgttaacttatcctgttctatagaatttgccttttctgcctattaatattatgattgtggaactgcctgggtgaaagagcaagaccctgtctcttaaaaaacaaattaaaaaatctgcctgaaatcgaatgtatgcacccaaggttttagtttattttccattgacaagtcagtgtacacacatgttctggatagaactgtcatcaaagtagaatttttcctttaaaatgtttcatctggtttctgtttccaatttcatgggcagaattctaggcgtaacagctgaatactgctttgtaatttttaaattgtagatagtgaaaaaagttacaatgtgaagagatggaaaattcccagatgaaagaaagctagatagtccattctcatattcattttcacccggggactaatcacctcttctactgtgatctcccattaaattagaactaacagttctaattatgtggctgaccaatgaaaatgggtataatacagtgggagatcctgaaacaaacttttttttttctttgcagaactcatagtgaccaaagagtctcatgaaggttgtgaatgttttatatgtgttaaaaaaaatgtttatttaaataatgaaatctgttaagcataatttgaagaactttggcaaatggctttgtgttgtatgatccttttccccattttattaaatgtttttattttccttgcaagaaaatgtgggagatgtatgattactctgttagcaaattaatgtcaaaggggaaacaaaagaaaatggcgtactttttatttgctgttgccaacattataataaaaatagttgttgagatgcttcctggcattatttacatgataatcactatttattagaaaagtgacagggcgctattgtaattcaggcctttgtcaccatttattgttagatattttacaagctatttggagtgtccattgtttcatgactgatgccaatgtgagcaatatcaacatggcaaattaggtctgtggttttctcctgaagcttctaaatcccatcctataggaatgacttgggaacattttatattattccttcattataatttctaaattcactcctcatttggtgttaaaagcagcagtgttgattgctggacgaaagaaatttagtagtgtcaggtatgacatgtacagacttgatagggcaatattttaattgttttcttggtcatttttatcattctgcattctttgttgaacgtatgcctaccataacatttacagtagattgaaattgttaatatattttttgtatatgaaagttactataattttaatatcatgccttaaatatcaaaaacattatgaaggggatatatagtaatcatagaacatttacttaggaaagaatataaattacctgcagccccacctcccaccattaaacattgtactttctcctgccgctttccttcgtggaggtggccagttctgctgaggcttctcggtgctgaagaatgaatgggaaacacggctgaactgtattctgttttcctgctcttctcgccatagcatccttcgatgtcatccctgtccgattccataacttgccagccaaaatcacttgttaaacattctcctgtggagacgtggttcctgcgccttgaaatgccgatttttatctttgttgagctgtggtttgccgtgtttgggtaaatactaaacactgggcctcccttgacagcacactcattggctcctcagagggcccggtgggaccctcatcctctgcctctttcatttgttttcccacagcctcttgtgactcagacctcttcagccagtccttgggtaatatcagcaagactgaagccatcgtcaccttccctaatgtccatcattccatccagggaaaacatgacctggcatgggtacctggatgtgaacagagaagcaaacagacttggaagcccaggaatattcattttgatactcagtacatttaaactggcagtatatattgagtattttttttattggaggacgttctttgaaagcaaggttttcattatgggcatggtattttaatacacgtgtgatgcaacgtattttcacaataccctgtcgttaaggttttacgtttgtggcagctacaactttgctttcagccctgcttatgactccaaagagctgaggttaaatgcatggtactgggcaacttatcttttacagatgtctttcctgaaagctcagagaattcaaagtaaatttaaggcacatgtcactgctcaaaagatgtatttcaaataagataaatacataatgacattaacttaagatattccaagatcagttcctgagttacaaagatatgattgcatttgatttgcaaaacactcaaatattatgaaaataggaagggtagcaccacgtacagaaaatactcttaggtaaagtgagtatgtccttaaaggtgtgacttatggaatcaagttcctagaaggacagaatacaggaacatgagtgatcttgggcttaatagcgtttaccacaagtaatgagtgaggaggttgtgtttgagcctgaaacaaatggaaattcttgaaaatggaaatgatagaagtcactaaagtgcaaatacatagacaattcctcatacccgacatgttggtgagcaatacagatttaagatttaagtgcagatttaaggtttttctcactctgatccctgagcaaatatgccctctgctgtggcccaacctgttctcattatagggcaaagctgatgaagagtaaaatacccactagctggtgctgatgtagataaaagcccctgttgctgaaaggtcagggggtattgtcttaaacgggctttagtttatgtggtggtcaacatcagtgctaccgagattcacggagagccacacagaggaaggtataattctgatggtggcctcttgatgttccaggcacaacttagccaaagagagcaagagaaagagtctctaagacatccaagaactgctgattatagctcctcctgaagcttgatgggacaatgtaattgcatactttatgaaactattaaaattattatctagacagtcatctaatttataatcctaacgaactatattttgttaacattcaatcatctttgctgttttaactttgatttttaaagccatctgttgagcctttataacatgcctattggtgcactggagtgaagacgcgtcatatttgcaatgcagatgatccttctccttcccacgtttttggttttctgtttgtctgtaatggctattgagatgaaaacacaaatacttttgttgcaggagaattggcaacagcgggaagcttgcatatttcgagtgaaatccttagggacgtgttcctctacgggtgttttgcctgtgggtgcagttggtttaagggagctgaattgtgctaatgctcactttctttcctcatctttgaattgttgtcaaattttgatgttgctgaggtctggaaactgactgttgattttgctgactcatattgtaaatcattcgataggagatgaagtcaattcaaccttaaccacaggatgaactgaaccaccattttttttttttttttttggaatgaccttcccttttttcagtggaaggagagtatatatatttggtaaaggcacaaagaactgaaatcaatctgatgaattttacatatggcttttcattttctttcaatgtatcttgtagttttctttcaacatagaaagcttaaacagctgaagaacagtgattcatggatgaagtacaagcattttcagttgtagttcagatgagacacatgttttagtgacctccacttcaccagtatcttgcagacaagtaagaacaatgcttttagttctatcttgttcaattttttttagtttgttttttgtgttttttgttttgttttgttttgttttttgttttttctgagacagagtcttgctctgttgcccaggctggagtgcagtggcgcgatctctgctcactgcaggctctgcctcccgggttcacgccattctcctgcctcagcctcccgagtagctgggactacaggtgcctgccaccatgccctgctaattttttgtgtttttagtacagatggggtttcaccatgttagccgggatggtctcaatctcctgacgtcgtgatccacctgcctcggcctcccaaagtgctgggattacaggcatgagctacctcgcctggccttgttgaatttttttcaacttttattttattttaatccatgtgtatcttagttacataggtaaactggtgtcatgggggtttgttgcacagatgacttcatcactcaagtactaagtctagtatccatttgtcctgatcctctcccttccccgccccccccactctccactgagccgcagtttgtgtcgttcacctatgtgtacccatgtgttctcacaatttagctccctcttagaagtcagatcatgtggtatttggttttctgttcctgcatcagtttgcgaagggtaatggcccccagctccatccatgtccctgcagaggacatgctctcattttataatggccgcatagtactgtttaattagttatatccattcatgtgatttcagatgattttctgtaaaatgtttgttaattcataatgaaaaatctatctggttatatagtcaaagatttcagtctcattacaacactaatattattctttaacccctttgagcttccattccacatcgttataaacatgggaatagatcatcagagtctctttcagttaaaaaaaaaaaagcttatatgtgtatgtaaaattttaatttgtattcctgattgtattattttacttggttaacttacgaaatactctaatagtgttaggctctgattattctaagcaattcacattaatgagcgttaatcattaaatgtcataaccattctgtcaagtagtggctgcttcattggtgaggaaactgaggctgttagaagttaactggcccctaacttcagtgatagggcttagatgtaagtaaaactagaccagacccagagtctctgcttttttttttttttttttttttggagacggagtttgttgcccaggctggagggcagtgactcgatctcagctcactgcaagctccacctcccaggttcacgccattctcttgcctcagcctcctgagtagctgggaccacaggcacctgccaccacgcccggctcattttttgtattttttagtagagatggggtttcaccatgttagccaggatggtctcgatctcctgacctcgtgttctacctgccttggcctcccaaagtgctgggatttcaggcgtgagccaccacacctggcgagtctctgcttttaagcactacactatgctctctgctttttagaaaaaaaaaatatgcaaaagagtacagattttcaatggcttagaaatgattcaaggctatgtattacgtaccacaaaaaatattaatatgttaaaaagctgtgctctttgaatccactttaccttaatatatggcaacaagataaaattatcctttgtgtgcctgtttaatcttcataatttatcaagatttctaatgtcaaaagtattaattagaatacaaatgaaaaattaattctcaacactctttccgttcaaatgcattccatgataaataagggtttagaacatcagtagaagggtctttgctaggggtctttgccattttccaaaaactaatcaactaacatagtatcatgcatatatcaacattttggagggataattgatggtaaccataaagttgattgatctttaatatatgtttatacaattaatagctctctgtctagcggaaaaattttgtttttcttttctgcaaacatactttgctggactactgtttttttcttattttctaataacaaaggcaaacttttaggtagagttagaatattcatggcttattaatattatttattatcattattcctaataaacacagttggcaccaggcttcatcttgatttactcaacatgttttcttgagtaaagagataggaagtgtttctctacagatgggcaaaggtgggcttagatctgttatgggtcctggggcataaacacacatgagtttgcatagctgggcacttacgtgctgtgtgtgcaccttctgtgaactcagagatgactcacaaacttggtttacagggcatgtttgagtaaaccaaaacgtgaatgtcatgtattttcattactagataattaactttcactcttataacaaataaaacctgggctttcagtggctttgcccagtaaccgtgtatttctgtttacatcacagtccaacattaggtctgggtcccctcaacacagggctctaatatctgagtaaaccatggagggagaaacccagcagctatgccaaccccgtgtgtttcatcaggcagatccatagacccaataacaaatgcagaaacatttcgtttttttttttaatatccctcccaattaccatcctcccccataatattcatcctggagtttctttatcttctttcctactaaaaatctgtgtatctttcttttctagacattactcaaaaattgtttattatgtttttatttacacttcctcttttttataaaggttaaaagactagactgttttatgagagttttcatttttccgatagataaaaggcgggaatcttactcacagaatcttaagcttgcagtgaactgtagggcgcgtcagttgacagtgtctacctcatactgcctgaattcctaaagacagcctcaaataaactatttgcaagtcatcttttgtgaccaggtttaaccatggttgatggacccttttccaaaataaagtttctcaggctggatttcaggacttgtatctgccgaaataatctgaggcaatatacgaatgtttcctgtgttgtttgctattatgcagaatgaatgaaggcacctcggtttgcattgtctttcatttggtccagaaaaccacgtgagcgatttgacaaccgggggacattgaccgacgtctagggcaagcgtggcctccaaaagtgcgctgttttctgggtcctcagagtcaaattttacatcatgtaaaattgtcccttcctgccaaaatcatcgttagaagaatgacgtgcaatttaaatacgttaggatgtgtgtggcagtaccttaaaacctatgtttttaattacatgtcgtgcatcctgccagcagtcacttttctatttgttttaaatcacctatgactaggacgaagtttgcactgtcttaggtctttttttaaaaaaaggtattggctttttaggagataaacgcaggggaattaaaaatacccatggtagtatctaccacttgtaatagggactgttttgtattttattaacaacaaatgcatgatatcatgccagtgctgccatggcctgagagaataaaagtataaaactgcctatgaaatagtctcagcaagtcatctgaaactgtgattttggaaaataataataatacctgcctattttactatatggtgagagtgaaatatatttctctgagtgttcatttatggtgccttaatgtacactaactagaataaacttcctgaatgcttttttttttttttttttgagacggagtttcactcttgttgcccaggctggagtgcagtgatgcaatctcggctcactgcaacctccacatcctgggttcaagcgattctcctacattagcctcctgggttcaggcgattctcctacctgagtctcccaagtagctgggattacaggcatgtgccaccacccaggctgattttttgtatttttagtagcgacggggtttcaccatgttgatcaggctggtctcttcctgacctcaggtgatctgcctgccttggcctcccaaagtgctgggattataggcatcagccaccgtgcctggcccaaatgctacttaatgcttacctgtgtcagttaaaaccattgcatcctagtgggttgtcctttcctatgactgaaagagcatcagtattccctaaaagtcattttaagtctctgccataagcacatgttaaagttccatattattttttctctgaacagaatccaacaatgtcccagattgttttaaagcaacttatttttaatactacaagcagtaaatcaatatgttttaacagagtggagacttggtgaaattcttcagaattttaagggaccttagagataatgtttgtttcaatttgagcaaacatttatatgggcattaaaactgttctataaaggaagaagaacacttgttattttatttttatttatatttttttgagacagaatcttgctgtgtcacccaggctagagtgcagctcactgcaatctctgcctcgtgggttcaggtgattctcctgcctcagcctcccgagtagctgggactacaggcactcaacaccacgcccggctgattttttttttttctgtatttttagtagagacggggtgtcaccatgtagaccaggctggtcttgaactcctgacctcaagtgatccacccgcctcagcttcccaaattgctgggattacaggtgtgagcgaccgtacgccgctgaaaaaaatatttagtcttaatagaaaacaaatatactgattttggggaaatagaggcatctaaaaataatagcctcttagcccctggaagattgagagaggggctgatttgacattagcaatgctgagacccttcctattatttcgtcttttatattcgtataatgctgtgaagtcaccagttttcaaaataagtaattaaattccatcttatttatttatttattttccttattagcatccttattttacaaggtggaaacctgggctctgtaaacttactctcagtgtgtcagggactggactgtcttggggtgagcagagatgctgcattcaacacgaagataggaatcagcccagggctgggccatgaggagtcccagttggaaagctgactgcccccaaccttgaacacgggcctccttctcttgtaattttacactttcccctctgctgcagtgagtatggcaacacagtttggccgtcctgagcttccagtgttccacaatgttctctggaacattcagggcaccttgactgcttctcatatgctccagtggcctctggatgccaaatcgttggtgacagcctggcatggcccaatcaaagagggtgcctcctctaacagctgcgtcttccacacgtgcagaatccaggcccacccaggcactatgtacctagggatttgtatgtatcagatcataacaaaacataggtggacttgttaagaatgatttctgtattccaccgtagaccttaagctgaaagtattgcagggaaatgaactcaacgtaataacagtttacaaacaggaaagccgtgatcttagtactcaggcctacaagaacggttgctctgttcattgcatgcttatgcagggcactttctgactctggcactgggtctgccactcatcttacacatttccactggtaggggatattttatctcaaaatgatagctcttcaaaggcatgagtctatctgacgaacatatttcagtacatgtcttcaaactagacattcattgggcatttacgtgactatgttaaaatgtgtcactttttacattagctatttaaataacgtgcaatttcataaatcagcacatttactagataggtaggatacttttgatccatttgtgtgttaaaaaattagcgcatgtttctctttatgcccacttgtattagcagaatagtgttttcggattccctgaatggatctgtattgagtctgtatggtgtatgctgtttttaaaatcattatttatcaagctcacacgtgtatgtttattgcttaggggtactattctgggtactttaaaagccctgtccaatttaatcttcatagtaaacctgtgacaaaactattgtgagccctttttaagacagggtccctaaaacaaaaagattaaacaatttgcccaagatcatgacgaattgcaaggggtagggccaggattcaaaggcaagaaagcaggttcccagcctgtactcatttttgcatttttgtgtttctttttggttttttcttcgtttgcttttttttttttttttttttttttgaggcaaaatttcactcaggtgcccaggctggagtgcagtggtgcgatcttggctcactgcaacctctgcctcccaggctctagccattctcctgcctcagcctcccaagtagctgggattaaaggcacccaccaccaggcccagctaatttttgtattttttaatagagatggggtttcaccacattggggaggctggtcttgaactcctgacctcaggtgatccacccagaggctggtcttgaactcctgacctcaggtgatccacccaccttggcctccgaaagtgttggggtattttaaattcaggggtacatgtgcatgtttcctatataagtaaacctgtgtcacaggttgtggtacagattatttcatcacccaggtattaagcccagtacccattagttatttttcacggtcccctccctcctcccaccttccaacctctggtgtctgttgtttccctctttgtgtccatctgtcttcctttagctccaacttataaatgagaacatttgattttttttttcctgtgttagtttgctaaagataatggtctacagctccatccatgctcatgcaaaggacataatcttgtccttttttatggctgcatagtattccatggtgtatacatgccacattttctttatccagtctgccattggtggcctttgaggttgatttcatgcctttgatattgtgaatagtgccgcaaggaacatcctcatatgctccagattattagaattggaaatagctagttttcagggagcacagttccagtgttgatgactaatgacttgtctaaaactcatgtttaagagttagcctcagccattaattcctgaatagcgttagattataaatgagcatatgggctgtgctgaatgctaaataaatatattgtctctgcttacagttatactcttaggctcagactgacacagatttaatataacatttccattgctttttctttcatagttatgcatttatatattttaatgaagttttagaaattatagttaacattcctaaaatgtagttttcagagggaaggtggctaattattgcagggtagataataacagaatttgccatcattatcagcaaacattaactgtacccttgtcatgtgtatgacactgtcggaggctctgagaattttccttctgtgttctcaggagcagttcataggtttcccagactatcatgtggtagctgccccaagctgtggccaaactgtccacatgccccaactaaaaaactcactgagtgttttaagtggtaggtgggcaatccaggaggggagacatttaataagtacttacagaaatactcaagtgatgctgaaagaaaagctttcatcaacgaaatactcatattgcttcactaatcttttaaaatgatatattatttttcatcatttgatagttttaaatttctctgctcacaacaaaattatttttgttaagtatttgtaaggaaacttaaaattgtgcttatcaatttgacagaatcattttaaaaaagttcaaaattatgaatttttacttaagttcaaattttaaaggaatgtctgtctctgacttatcatattacaaataaaccagtaatgtctgtgcatgatagaagagaaaaagcaaagtgttttcacctccaattgaagaacatgtcattgaggggctaaaaattattgacaagctgtgacccacagtatgttttatggagttgcttttacatcagcttccttattgaaagaagaagttaccatttagattacttcagtggtaatcatcagacatgaataaattattttaaatatatttaattgctgattctgtagtgtaaatatttttttacagaattaaattttcagtctactgcaaattttcttagagatgatcttctccattttccaaactctgtatacccattttttcccctaaattcatcctagggctatactgcacttacgcattaattaacttttaaaatgaaataaaattatcactgcataaagatgatctctgtatatagggtgtcgctgtgatatgagtgtgacatctagcagtggtatctgtgcatataacacaatcacgtgtactttctactcatcccatgtaattactctttacttgaaagactttgatccttcctttccttgcctctttctttattggccattatcttcatttgctaattgagattctatccaccgtcttcaattacattctcccattcaaacatacagttctagactctgagtttgatgctattaatttctgtctcaataattagaatgacccttataattgcatgttttaacttgattatattcccttcacttcatttaactatgagactgcattactagtgagaaaaaaaaatgatgttccattatttatatagctgttctttttctttctaacttaaagcttcaaattaatcgggcattcacaatttgtgaatctatttttaggggtcactcctgaaaatgagtatatatgataaacactgttgtccataaaattccctcagagtagaatgctaaattcttttctgtgatcatacatcattatgtttgaaaggaacaaatatcgattgagcatatatagcccgtccaacatttcgctaataatgtgacgtatcttatttgattattaaaacaatgttttaatccacattttattatttcattatataagtgggctgggcaggttcagcatttactgatctctctaataagttttaaaagataatatactttgggtaaggcatgtggaaggtgtattggggattacaagaataaatttactgaaaccaagggcaagcttagaactttaccctcttttaaacaaatcatgcaaacgataatctagatatattccgtttttttcttatgtatcataagtttaaagtaaactgagaatgaaacacagaacctaatcagaaaactaataggtctattttgttggtgctatgttgtttttttagttctgtcttcttttggtgtgtttaagttttagcattgaaatgctattcaggtaggtttaaatacctaatttaggtatacacacacacacacaccgacacacacacacacacacgggtgtgtatgagtttctgtgtacttaaaaatgtaaacattacacacacatcacacacacacacacacgcagacacagacaaacagaatcacctagcaaagtactaagtacttgtcctgcctttgtggttatcactgtgaaatcatgttataatcaactaggctaaaggagaatttatcattttatttgtacgaatgtatattacatttgcatttgctgcatagtcaattagtcacctaaatcgttaatacgtaatatttcaatgacaagataagaattgttgtttattttgttttatgtttagaatttctgaggggagattatattgaaaaaagtataaatgaattgagtcaatattattctgatcatctataacttttcttacaggcaatggaatgtaaatataaatgaattttaagccttatagcaagcttttccatcctgtggcccagtaaggctttgcatgtggccaaacacaaattcataaactttcttaaaatattgtaaggttttctggtgatttttttaaagctcatcagttatcgttagtgttagtgtattttctgtgtgacccaagacagttctttttccaatgttgcccagggaagccaaaagattggagaaccctgccttatagtttaagcattcaaaaaaaaaataaataaataaatgagaaaccgtaccattgcatttcttttagcatggatatatatgtcataaatcattattgttttacaataaatatcaaattcagatgagattgggcacgttcagggtggtatggctatagataataagtaccaaatttaaatcatcggtgctatatgggatgtctatttattcaatgctttctcatttacttttaaagcaaatacaccaaaatagatggctgtttcgcagcacttggaattggctggtcaatcatgtgttggaatgttcaataggtctgttgtcctattttcatatttggagactctttagttttttgcattatttttcagctggacttttttgcttttattccataatagtgggtacggaaatggtaagccattatcacagcatcatccccggcttaattaacagagtggggcaattttggcaccttgaaaatttagaaataaatataccaatgcacagtaattacaagttcagaatttagtatcgtgagcttttaaatatcataattgttgttattttggttggttggatttgtgaactcttgtaccaaagacatacagatattagattaacacaatgttagataagaaggaattctaacagttagtgccatgtttccatttttctaaggtgagttccatgacaaccagtgagctaccttgcctttcatatggccagtgctggcagggcaggattagaacttcttttgttttgttttgttctgttttgttttgtattttattttattttttctttttttaattattattatactttaagttttagggtacatgtgcacaatgtgcaggttagttacatatgtatacatgtgccatgctggtgtgctgcacccactaactcgtcatttagcattaggcatatctcctaatgctatccctcccccctccccccaccccacagcagtccccagagtgtgatgttccccttcctgtgtccatgtgttctcatttttcaattcccatgtatgagtgagaacatgcattgtttggttttttgtccttgcaatagtttactgacaatgatgatttccagtgtcatccatatccctacaaaggacatgaactcatcattttttattgctgcatagtataccatggtgtatatgtgccacattttcttaatccagtctatcattgttggacatttgggttggttccaagtctttgctgtcgtgaatagtgccgcagtaaacatatgtgtgaatgtgtcttcatagcagcatgatttatagtctttgggtatatacccagtaatgggatggctgggtcaaatggtatttccagttctaggtccttgaggaatcgccacactgacttccacaatggttgaattagtttacagtcccactaacagtgtaaaagtgttcctatttctccacatcctctccagcaccttttgtttcctgactttttaatgatcgccattctaactggtgtgagatggtatctcattgtggttttggtttgcatttctctgatggccagtgatgatgagcattttttcatgtgtcttttggctgcataaatgtcttcttttgagaagtgtctgttcatattgttcaccactttttgatggggttgtttgtttttttcttgtaaatttgttggagttcattgtagattctggatattagccctttgtcagatgagtagattgcgaaaatttcctcccattctgtaggttgcctgttcactctgatggtagtttgttttgctgtgcagaagctctatagtttaattagattccatttgtcaattttgtcttttgttgtcattgcttttggtgttttagacatgaagtctttgcccatgcctacgtcctgaatggtaatgcctaggttttcttctagggtttttatggttttaggtctaacgtttaagtctttaatccatcttgaattgatttttgtatagggtgtaaggaagggatccagcttcagctttctacatatggctagccagttttcccagcaccatttattaaatagggaatccttcccccattgcttggttttgtcaggtttgtcaaagatcagatagttgtagatacgtggcattatttctgagggctctgttctgttccattgatttatatctctgttttggtaccagtaccatgctgttttggtttctgtagccttgtagtatagtttgaagtcaggtagtgtgatgcctccagctttcttcctttggcttaggattgacttggcgatgcgggctcttttttgtttccatatgaactttaaagtagttttttctaattatgtgaagaaagtcattggtagcttgatggggatggcattgaatgtataaattaccttgggcagtatggccattttcacgatattgattcttcctacccatgagcatggaatgttcttccatttgtttgtatcttctcttatttcattgagcagtggtttgtagttctccttgaagaggtccttctcatcccttgtaagttggatttctaagtattttattctctttgaaggaattgtgaatgggagttcactcctgatttggctgtttgtcttttgttggtgtataacaatgcttgtaatttttgtacattgattttgtatcctgagactttgctgaagttgcctatcagcttaaggagattttgggctgagacagtggggttttctagataaacaatcatattatctgcaaaaagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgttatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatgatagtggattagctttttgatgtgctgctggattcggtctgccagtatcgtattgagggtttctgcatcaatctgcatcaaggatattggtctaaaattctcttttttggttgtgtctctgccaggctttggtatcaggatgatgctggcctcataaaatgagttagtgagggtgccctctttttctatttattggaatagtttcagaaggaatggtactagttcctccttgtaactctggtagaatttggctgtgagtccatatgatcctggactctttttggttgataagctattgattgttgccacaatttcagatcctgttattggtctattcagagatttaacttcttcctggtttagtcttgggagagtgtatgtgtcgaggaatttatccatttcttatagattttctagtttatttgcgtagaggtgtttgtagtattctctgatggcagtttgtatttcagtgggatcggtggtgatatcccctttatcattttttattgcatctatttgattcttgtctctttttttctttgttagtcttgctagcggtctatcaattttgttgatcttttcaaaaaagcagctcctggattcattaattttttgaagggttatttgcatctctatttccttcagttctgctctgattttagttatttcttgccttctgctagctttgaatgtgtttgctcttgtttttctagttcttttaattgtgatgttcgggtgtcaattttggatctttcctactttctcttgtggacatttagtgctataagtttccctctacacactgctttgaatgtgccccagagattctggtatgttgtgtctttgttctcgttggtttcaaagaacatctttatttctgccgtcatttcgttatgtacccagtattcattcaggagcaggttgttcagtttccatgtagttgagcggttttgagtgagtttcttaatcctgagttctagcttgattgcactgtggtgtgagagacagtttgttataatttctcttcttttacatttgctgaggagagctttacttccagctatgtggtcaattttggaataggtgtggtgtggtgctgaaaaacatgtatattctgttgatttggggtggagagttctgtagatgtctattaggtccgcttggtgcagagatgagttcaattcctggatatccttgttgactttctgtctcgttgatatttctaatgttgacagtggggtgttaaagtctcccatttttattgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatcgttgttggtttaaagtctgttttatcagagactaggattgcaacccctgcctttttttgttttccatttgcttggtagatcttcctccatccttttattttgagcctatgtgtgtctctgcacgtgagatggctttcctgaatacagcacactgatgggtcttgactctttatccaatttgccagtctgtgtcttttatggattagaatttcctactcctatgtcccttctactagagggtacttctactgccaaaatggggtatattagtagggatcagaatggtgattgatatgtcacagtgaaggtatagaaccagtagtgagtgaggaggttagaaggtgccaggatgagaaaataatcaaaaaggaaaggaaagcttccaaggtaaaaatcatggtaaataagagaaaagggaaaaatgagaataagaggcttaagagtgtagattgttgtcatactaatttattttcaatttaaaaggttgacgtcagcaaacaatatagataagatggacacttgctatagaattttgttctcattttttgcagtctaatctaccaaatgtatataagaacgtacataagctatatagcctacagagccacatccaacagggtggatgtggttctgcagggcttctgatcaagacatagagtctcttttccacccctataaatgtggactgcccttgagactttctgtctacaagaaggtagcaggagtgattctgcaagggttccacatctaagtcacacttttctgctcctgcttcttgggaaccctgaaatggctatggcgagaagcctgggctagcctctcaaggacagagaatacaatgagagaagcccagctgccccatgccaccaatgtcgacagcacctgcacagtgaccacacagaaaagtggtaattaggactagaaatcaactggaccccattactcgcttggtaacattttggttatttctttccagttactttcactctgcatacttttatatatgctgttgtattgccatgatcatcatagtattcatgactttatatctttttaacttaatatttcaccattatttttctaggcaacattctcttggacaataaaattctcccttctgtgaggacattatgtatatgtagtttctttacctttagatagttctgacttcaagtttttgccatcacaaattatgctgtgataattgcgtgatcattgtatatttactctcctaatatacctttcaaaaaatctaagggctggttttatcatgtctacatttatccattgggcttctatcagttgtctttgtgtaatgttttaagaaaatatatttacaattttggatgcttttgctatcataaaataaagatgtcaattacttaaacatattccgttgaacaataaaagtatagcgcaggtaagagagaagatcagactagagcccaacactgttaaaaagtatttagaaaaaagtgacgaagataactttaacctaaacaatggaagattcactgtcctaaggatatgacccatcagcagagataattaaatataaatggtttcatttaattggttgacattgtgagatcaccttagtgacttgagctcaattttccccagtaagaagtaattaaaaatcacttttcaacaatgatctttcttgatggtcgaggtcttacactattcctcagatattattattcttggcagaaatttgtctatgaaagtgcaaagtaaaagtcagtgaaagatgcccagggttcacttagaaaggaatgtaatatacttaaagtggaaaagagtgagataagagattccaattcagcaagtatctcaaagagccatcaatactaattttaaagacttcaatattaaattaaggagttgacatcagttctgcaaagatgtcagagtgtggctgagatgtctagtgtacattaacatcaatattttatctgaaattttgaggcgaaggtgtaatttctctggcacacaaactaatctgaatctctcacaatctgtgtcggtctgtctctctccctcccctccccctcacatccctcttcctcacatccctcttcctcacatccctcttcctctctcttcagtgttctagacaccttttttctttgagcatgttagcatgggtctgtttcctataattcctacattcccaggtcttagagtttgttttaattattataaaagaggcttcagacattgtgtatcccagccagagtgcatgcagtatttataaaaacatctcttttgagaggtgggtggacatgggggtcatttattatatatacccatagtttctcaaagatttaataaccttccaaacctattatttaaacaatagaaaaaccattgtcaggagattacatacacggtgaagtgcaatttctcttaatttaaaggaattaggccttgcgcaaatgacttgctctctcagagactgcactttaatctgtaaaacgggaataatacctaggtcatgtagtggatgacctttaaaaatgatgaaatacttagcctctattcttgctgaagattcatttcctttttagcgctttgctttcaagacggtgtcctcacatagctgctgaggctctgggttttcctcagtagtttaacattctcctctaggggcagccacgagcctttggtgggtgaccctccctttccaggcttgccctaccctccactctgtgagtctccctgatgttgattggatcataagcaggcaggtggcccaggcctaaaccaatgaactcagggcattcccttggccatggtgattgatccaggcatggtcacatatcctttgcttccagtcaggagaaagttttttgtttttgtttcaaggctgagggaagaagctagttcataccctgagccatgtgtactgagcccagaacttcagctgccacttcaaacccggagagaagagacttcccaagaagtagggaagaactgagaagcctgatcagattgttcctcaagcgcacctcaccactaacttttgagtcatagaatgagttacttttaatattgaaaataagttttttattaatgacaaaaaattttctcattgattgctgaattatttgagtaattcagaaattttcctactacagttatcacagttttgggtctgaaaagtggcattcagtgtttccgaacttccacaaagctatgtatctaataacttttaaacccagcgaatcatattgttacatcatttgataattttatctttctcctttcttgtaaaccacaagaggatggtgtttatccccatctaccgagagcacttagctgtgtctctagatccaacttactatctcttcttctgtgcttcagtaacgtcctctggtgacctttacctctgtagtcaccacgttaaatgcaaacttctctttatgcctctgtctcatcttctgttcagcatcaccacatactgaatatctggttaggtttgccatatacagcacaaatttcccacttcaatttggaactcagacaaagaacatttttaaaattttattacattccaaatgttgcgtgagacaagcttgcattaaagagttattggtcgtttatctgaaattcacttttaattgagcatcctgtatttttatgcgctattataatcaatctagcaaccctatacttgttgcactgtatagttacttcctccgtgtggttcatacaacctttccctgaaattaagatggaagttatttattgctgggcaggaaatttcttgcaatattaggggctaaaataccaagcatttattatttcaaggtttctgtgggtcaggaatctgagcatggtttagctgcctgcctcagccctcgaggtttttctgtaagttgctgttaacttgttgctgggactcagactcaactcctggaatgggctgggctcccttttatgcctacgcacacggctgtggacagccctcagtcccttccatatggacatatccaggggctgcctaaagacatgggataggcttctctgtgggtaagggatccaagaaagaggtggaagccacagtctttttacaacctaatgtcaagtgatatcctgtcacttttgcaatattctaatgaatatgtgtgaaacacctggtccagcccatatttaagggaggaccgcaggagttcataaataccaggagggtgggttccatgagcttagttagatgttccttaccatatatacagttctggatttgtggagcctcactttccactgcaagcaaagcagaaatagttagagaatattgttgatccttcagtttttttttttaattgtcatgtgaataagatagtgtctgttgtaacacaacacctgggaaacctagactatgctgtgtaacgcgggagccatgagacccactggctatttagatttggatttgatttaattataggtaatccaatttaaactttattttctcaatgacactagtcatatctcggtagccacacctgctcagtggttactgcattgcaagaggaaacaaagaggattccagacattcatttgttcagtgcagacttgaccctattctcttggtccagtgttttattttagatggcgtagagtttttctcattaaaaggcacaaacacttctcttaggtccatcttttcaaattttaggtagtcatgcacctactgaaatgatccgcatgataaactctccgtgatacgccttcccctgagaaagagatactttaagcatcgtgcattgtgtttccttttatttgaaaatattatgtgctgctttggtggtattaaaccgtgatattcaaatgaaggatgctgattattacattatgcaagaaagaacacaaaatctagagtattgcgagaaacataatttatgtaaaaacatgcagacaattgcattcaagtatttgatgtaagtaatgagagaatcacacataatgggcattttttattaaactgggatttagatgatttgtctaatgaatgaagttactcaagtaaattggattgtgagccaagaaataaaaaagaataaaataaaaagatgaaaatttcagaagcttggcacataaatatcagaataagcaaattaactttgttctaaatattctaccagtttatctgcattgggaaaaaaacaggcaagtttgggatttggcttagtgaaatttagtgggaccgtcccctaaggaattgtgtagtatttggcaacgtatcactccatatccagtagttattgtacatttgttaagtgtcaactaaagaaactgtagagtacaaagattgatcacatatgcatctgttcttatgtatttcttagttcaggagagccaataagtcatgcataaattgattgtattacaaagtaattaatagggtcaaatattcacaataaataccataagaaattgtagagaaaattcaaggaaggtaaggagttgtttccacaactgtaatccctacacctggaaaacagcctggcgtagggttgcttacaataaatgccaggtgaatgaatgagttaggaaaactgcatggacaagtgaacggttgagctggacctttgcgggtaggtttcacacaggtctgtgatggtgatggatatttgatccagaggaaactaacagcatgggcactaagcaggagcatggatacctcacctttgtgtgctgaagggcaggtagtacagctggactctggtaagcaccgtggaggggaacactgacagatgaggatggagagatcggtgcattctgcatatggaaggccattatcccatgctgaaggtgtgaacttacagtctcagttcgtcaactgcagccctgggataatgacatttgcgtaacacagcttgtacaggcattggaataagtgaatgggaaaagtgatttgaatgcactttgcagggtggaaaggagtaaaaatgttacaggaattcatgcttatgttataaatgagagaagatcatgatgaatacataggtaatccccaaacagaaccatttgaaattctgtgtcccttagctacctttttctaaacagtattaatttagaaaaaaaaaaatccacatgctagctatatcagtttacttttgtcagagttctagctcctccaacttattctacttctcttaagtgaatgtaataaaacaaatgttttccacccagaattcatgtttgtagaaacagaatttgaaagtgtactgctaaggttttcatccattgtccatgttccatattccaatactccgactatagactttacctctacttaataacatttcattaatctcattacagtcagaaggaagtagaggcacctatagattaggaaaaaggggaagtatttgaacattttaaattcaaggtatacatgcatatgcttttcacaggtggctcttgaattcaatttttcataaattatccgaatatacggaactgcatgaaatgagacagaatttgttactttttatatcattgagacgcaaatgcttaaattcatagactctacccaaggcaagggggtaattcaaaaagagaaagagagatggggaaagagaagagataacagctagttctgcagagagaaacgcgtggactgtgaaaggtccttcactcttatcaacaaggaggtttgggtaacttttacaagagaagcccctggagggagaaaacaggttagggatacatatttttaatctttgactcacccacaattccttacctagaggttttgagtattcaaataattatttaatctcttattgattttacgatctcttaggctctaacactcttctatgcacaaaggatacagtatggaggaaaacacacacgcaagccaaaatctcttctgagttacgttctataataatagtggaaacaggtactcatagaaaacagaagtaaattacacagtatcctaaatgatgacgcatgctatggaaataattcaggaagggcagacagaaagtgctgctggtggaaggaagatacgtttaacggtaaagaagcatcccatgaatagtcctcaagggggcgtttgaacctccacaagtgagaatggggtagggagcaagccatgcacagggcagggagccatccaggagtgtgctcttccggcgttggctctcatggcgtccctgcagcagcaagggactgatgcactttttctcatatttcacaagattcttctaatgcctgtgttgagaagagcaaaatatgagaaaagtaacatgagtttggaggctgccatttcatctggaggagagaaaatggagacaaggccgcagtagaggtggtcagaattgagtcagatttgggatatgttgaagaaaactagctgaaagattaaaggtgggatgtgagaaaaagacgagtatttacaatgcctcatgttttttggcctgaggaagtggaaaacgcagtcgccatttatctagatggaagaaggcacatgggagggaccagctttagaggaaggatcaggagttgccttttgagctcaggaagattgaggcacccatcagacatctgtgtgcagtattgagaacactgctggactttgctcagacatgtgttggtgacgtacactatgttaacattctgaaaccgtagagacggtgtttacaccattaagctgggcatcaccaccagtgagcttacagggatgagaaaagaggttcaaggactaagccagcaggcttacaggtagggagaaacatccagaggtcagaaagaaaagaagaaaccagcaactggaacagagtaagagtaagcggctgataagatagtaggaaaatgaggagaacggcctgaggatagcagagatgatcaggtacctcaaaggccaaggttaaacagagcaaggcctggcactggcggttggataagcagtcctgatatcatcagtcaccgtgtctaaagcaactgtggtggaggctgaagacaacagagagccggaatgaagttagttcaaaggaaaatgaaagggaagaggagagttttattgtaaggaaaagaaataaagcctaacttgaatagccaatgaggtctaagagttgggttctttttttgtgttttaaaaaagaattaataacagcattttttaaaaaatgtgagaatgatgtactccagagtagaaaacatgatgatctaagatgttcatcttgcacacatgttggtagcgttttgtccctgcaaagcccgtctattgtccttctgcttctcatctgctcactgttgtgttctgtgtctgtaacttattttaatctagtgttgcatgttagagcccttttttctacttttaccacatcccttttctaaaaatacgttatattgcaatattactaaaatataaaaaataaatgtaaaatatatattgagagagagagtaagggtctcactctgtcaccaagactgagtacagtggcgcaatcaaggatcactgtagccttgaccttttggtctcaagggagccctttctgcctcagcctcctgtgtagttgggagtacaggtgcatcctaccatgtcaactaatttttttgtgtgtgtttgtgtatatatgtgtgtgtatatgtatatatacatacatacgtgtgtgtgtatgtgtgtgtgtgtgtgtgtgtgtgtgtgtgtatatttttttttatttttgagacagagccttgctctctttcccaagctggagagcagtggtgcgatttcagctccctacaacttctgcctcctggtttcaagcaattctacggcctcagcttcctgattagctgggattacaggagtctgccaccacgcctggctaattttttgtatttttagtagagatagggtttcaccatgctggccaggctggtcttgaactcctgacctcaggcagtccgcctgcctcagcctcccaaagtgctgagattacaggcctaagccatcatgtctggcctttttatatataattcttggtagagatggagtctgagtatgttgcccaggctagtctcaaactcctgaactcaagcaatcctcctgccttggtctctaaaagtgctggaattacaggtgtgaaccactgcacccagcctgactatttatcattttaaattgatcatataaccaatatctttttatgtggccaatctgtatcttccaaacagatggatttatctgtcccccacatatccttttttctgccatttgcatatccttaaatggttgaatttttgctgctaatttctgcaacaagcaagattttatataaatcagaggtagctacatacattttagaaaatgttataggtttaatttttctaatgtagtctctcagccaccgtcattctattccagtgtgttaacatttctattaccatttcttttacatgaacactttagcctatgaaatttaacatagtttgttatttaaattgaagtgtcaccaggcacccttcacaaagtcttacttagatacctctaagttacgtaagaatgctttctgttatagacacgaattttctaaactgcaaggaaaaactgtttttctcaccttcgaagacactccttccctaaaatcaggattttccaagttaaaatacaggccctctggaaaaaattatctggttttctacttcagaagtaggtagaaaaaaaaatgtcacctaagtaacatcttgggtttatatgggaagttgagggttttacatttatctacagatattctaagtttttttctcctccccgtttgttgctgttttctagcagtcccctgggaaacacaaaaagatttcacaaacacccagcacaggggcaggcagaaagcacagtgccttcagcatgtgctgtctgacatggtggccactgaccccacctggctgctgagcattcaaaatgaggctgctgctgctaaggaaatacattttaaatattatttgttgttcattgaaacaaatttaaattttaaaaagataagtagtgtaaaatattgtctcattaaacacaccctgatcattttggtagggctacattttgctttttttatgcttcaatagttttggggcaataggtggttttgggttacatagatatgttctttagagctgattttcttgattttggtgcacccatcaccccagcagtgtacacggtacccaatatgcagtcttctgtcccctgctcccatcctacagttcaccgtgagtccccaaagtccattatatcattctcatgcctttgtatcctcattgcttagctcccacttataaatgagaatatacagtatttgcttttccattcctgagttacttaacttagggtaatggcctccaacttcatccaggttgctgcaaatgttatttcattctatgttatggctattattgtgtggtatatatacattttatctttaattgtgggaactttagcatccaaataacatgtgctgtaggtgtataatacgtatggtcttttatagacctgttacaaaaaagataatacaaaatattccattaagaacttttatgtttatgtattttatatcaaatgcatattgatatgataatctggatatattgggttaaatgaaatatgtcataaaactgactattttgcatttgcttttcaagtagactactacaaatttaaaataatgttatggggttcacattatgtttgcatcagacagtgctgctctatgacctcatcattaagaatgtaattaatgcaagattgggaattcacttattaaagtgtgagcatgtaaataaggtcaagaaaaggatataaagagatgtacagtcccataattgcaaactttgtttcaattgttattacttacagtgacaccttgaagagtaagagtaatgatagtttatccagtatatatatatctgatactgtgctaggcacaggttggttggtgcaaaagtaatttgcttttactttcaatggcaaaaaacgcaattagttttgcaacaacctagtaagagtgacataatgcggctggagtgacaacacgtgagctaacacctcatggcatgaccaggaagaaatgatgagatgcttagtgattaaacttgtaataaaaatgatacttgggccgggtgtgatgggtcacgcctgtaattccggcactttgggaggccaaggttcaatgatcccttgtgtcaaggagttcaagccaagcctgggcaacatagtgagaccatgtctctacaaataactttaaaaattagctgggcatggtggtgcaccggaggtcccacctacttggcaggctgaggtgggaggatgacttgagcttgggcacttgaggctacagtgagcaatgactgccattgcactcagcctgggcgacatagcatgacaccacctcaaacaaaacatgatgcttatattttctacaaatggcacatcttttagtaagagttgttttagagtcctaaggaatttgtgggacaccacgtgtttgcgcttctacagctgagatacccggcacacagaacttaaccgagtggatcaacagctgtaactttcgctgcaacagacctccatgtccttttgaaaagaacagtgacacctggagggtgtgtagctctttgggttgctgatagttactggctaggcgtaggtatcatattaagcagtggaggctgaaatatagatacctgtcatgcatgcaccagcacatgaattcttagtttctctaaacacacatctgtacccacctaaacttcactgtctacacagcctctaccaatacagaaacctcaggtgtcatggacaaaaacatacaagaacataggaaactctacaataattataaaaattcctactgctcagttgaaacagataatgaagtctctttttcaggactactatcaaactatatatatacatatatatatatttttttttttctttgagatggagtcttgctctgttgctcaggcttggagtgcagtggcacaatgtcagctcactgcaagctccacctctggatttcacgccattctcctgcctccgcctcccaggtagctaggactacaggcacaaactgtattttttaaatacttttagtacttgaatctttcctccacctcagcaacatattttaaaatcttatattctcaaaattcaatcgtgtcttgtgtgagggactcaatcacagaagtatgtaaaccaataaggtacctaaataaattactactatgaaaacattcaagaagattttgggcggggcttggtggcttatacaacagcttatatctagatttacgcctggggacattggtaggattagctggcattgcgtttgattagtttaggggttcatttctgggaagcatgccaggctgtttcagaggtcacctgcaaccctcaaggatattagcatcacttacctgaatgtgtaagtgttctctgtccaacaagtacagtgtgtgactgttgttttatgaatactatttagatatgtttttaaatgtagatggattctatatttatcatttgtatccattaaagaaaattaatcttttttaacatcattttgtttttttctaacttttgtatatttcaaatatttttgtcatttttttttcttccaaaaatcctgtattaattccttaaactcatataatctaatgattacattttaagagaacactatcaggtataataaaatttaaaagtattctttaaaaacatgataagtattggagttttcttaatgtaatgtttataaagaagagaagggaatgacacatgtaccaacagcttactctgcttatttaatttctcctcacgattattcctcaatcccacatcaccaccctaaaattaatttgagaagcctggaaaacttatataacagatggaaagtcacctaacgagtaaccaaaccttgattcaaacccagtgtttctcttttcatggcatggtatttagagtagtaatttttgaattaatgatgaaggggtataggtgtagaaaattaaaatgtaatgacactgttgaataagtcattacatttccaaaattgtaagcttagcagtattagtgctactgattaatcaagatcatcacatccaccataaaaaaattttattatttatatgttacttcttgttttaaaattatttccttgaattttactccacttaccatatgtagatagtcaacagagttttgaaaaaacactcactttaaaacaggaagttttatctagctagatttaattcacaccaaatgatgctgtagctttacctaatattaaatatttcacaaaacaatgtctgtactgtgagttgaaggataaaatctaaataaaagtaactcacacattaaaatacaaacgtaaaaacaagaaaaaagaaattggccaaaatccataacaccaacaatgtagattgctgtcttggatatggagtaaaataactctgagttatggctgatgggaatgcgaaatggaacagccactttggaagacaattgggtggtttcttagaaaactaaacatactctcaacatgcagtccaggaagcacactccttgttatttatctgaaggagctaaaaacttacgtgtactgaaaaacctgccaagggatgtttttagaaggtttattcttggttgccaaaatctggaagcaaccaaagtgtacttcggtaggtgaaatgataaacttgtggtgtatcagacaatggaatattattcattgctaaaacaaaattaaccgaaagccatgcaaagacatagagtgaactgaagtgcacgttactaagtgaaagaagtcagtctgaaaaggttacccactttgtgattcctactctagggcattttggaaaaggcagaactgtagagacagtaaaaagaccagtggttgcaaagggttggaggaaggggaaatcaacagggaaatttttagggcggggaaactactcagtgtgatactgcaatggtgaacacatagcattatatatttatccacacccatagcatgtacaataccaagagtgaaccctattgtaaactgggggtttggatgataatgacttaccaatgtaagttcatcgattggaacaaatgcaccactctggcgtgggatgttgatagttggggaggctctgtgtatgggagcaggtgttacatgacatatcagtgtaccttctactcaatgttttttgtgaacctagaaaaactgctcttaaaatataaaatctatatttaaaaaatcaaagtaacttaggtaaaataaattaaaaatatcaaaatttaatattctggcaagttagatttatgaggatcaaaactgttcatcaaactggcttaaattttgtgtaagtcttgaattcacctctattctgtttattattttatcagttacactatatcctcaaagatttactgtcaagataaaaccaaaaaacatttgaacatcaaaattacctaaaaacaagcacttttcttttgtagtaacataaatccattaaactttgctgagttttctttagcaaactttattattggaaaatctgctacattttattgcagaatgtttcttagatgaatactggtaacataacaattaaaagacatgcatataattttggaaagaaaagttgcgcaaagcaggcagggaaactaattacgatgtcgcactggtttagtttatttagaatcatgtaaccatatattgcttcagtgtttaaatgttgccttaatgcttacttgcttatcaaggttgacattaagggaaattgcttagtttagcaaagtcgaaggcaaatacagaatggttagtcaaaggcacaatgccaccataaagaaattaattttaaaggtatgttgtgtactatacttactgaatatttaaacgaaagggatatgaactgatgaagtcttgacttactgaaccattataaaatctaaaagaattaaattctatggcaaagaaaaaaatgcagtgacatatcatatagcagattatgaaaaaatgaacaaattttgtttcttttgcacaattcaaaatatctgattccttgaaactggttccagaatcagtaaaaaatgatggcagcaatggttttcttatgattcgtggcagatttttctgctaaattgtaataatttttatggctgttgttgacgttggaagaacacattaaacttttgacattttaaatttagatttttaacaggtatagatcaaaatgtaccgcttgatgaactctgtccaaaacaatgtcaagtagtaggaggtgcacagtggactttgcgtgttcagcttgggttcagtcctttttcttttatctcaacagcagcatgaccttgagtaagccattcaacttattccagtttcaattttctcttctaaaaaattaaggaggaatgacaagtttacctctaagattcctttaattctgtggctgaaagcctgcatttttacagtcaaagagaccgggattttagccctaattctgtcacttactgtttcttatcaattatgtgtagctggtgagttatgtaatgtttctaaggctcacatgtaaatgcagatggtaagagtgcttgctttagagggttgttcatggaattaaatgagataggaagtagcacattgcaagtacttcatccttctgaacttttatcatgtcttaagacatgacttttttttttttacattatttgtttatatttcctggaaatgtatctcttacattatttacatttcctgcaaatctgggactgctcagtttttaagaagtgccgtgatttaatgcaaaccagaagaagaaggacaaagtgatcaccaaagaataattaacaatttttatatcaactgataaatacatctgatgaggtatgcagtggcctcaagtaatattaaaccacttgttcagcagagaacaacagcagtatgtcctttttagaatttctccttaaggaaatattagaaacttcaagttccttttcttcttcttttctgatatttacagtacaccaccttcacgggtaaaatgatgctttcatccaagtgtgactgagtaaatgtagtatcaccttatagaaaataattgcaacttgccacaaggcaagagtgaagacatggagtgtgggacattgcgtggacatgtgtctgtgcacacacaagtacaaagacttccagagtgtctgcaagaaagtggggacatccacagtgtgtaaatggaggcttcagcctcatgcaagatgagaaacgtggatatttaaatcacctgaaaatctccttttccttgcttaagcataatgattgtctgactttcaaccgatgttcggacctcatgaagacacatgaccaacacttactttattgaaatatattctttattctggactatttcattgaatttaaagttgcgtatatatatgtcaacataacaccaaatttccaaagttggcttcattactttacaaaaaatggttttcaatcattattttatttttatgcttgttgctggagagtttcctaaattcagtactttccaagaatcagaatgttttgtgttactttatgataaagttagactttagaaagaacaattagccagatttttgctatataaaagacaaatacttccccttaagtcttagtcagtaaatcataattttcaaagttaatacttggaattaagacgttattttttaatgtcctcagtgctttttctttttttttttaaattccatacttttggagaacaggtggtatttggttacatgaaagttctttggtgatttctgaaattttggtgcacccatcaccagagcattatacattgaacccaattggtagtcttttatccctcaccccctcccaccctttcccctcaaggcccgaaagttttttatatcattcttaagcctttgcatcctcataggctagctcgcacttatgggtgagaacatacggtctttagttttccattccagagttacttcacttagaataatggtctccctatcctggctaacacggtgaaaccccatctctactaaaaatataaaaaattagccgggcgtggtggcgggcacctgtagtcccagctgctcgggaggctgaggcaggagaatggcgtgaacccgggagggggagcttgcagtgagccgagatcgcgccactgtgctccagcctgggcgacagagtgagactctgtctcacaataataataataatggtctgcaatcccatccaggttgctgtgaataccattaattcattgctttttatggctgagtggtattccatcatatatataccacagtttctttatccactcgttgattgatggatacatttttacagtagtgaattgtgctgccataaacattcatgtgcaaatacctttttcatataatgacttcttttcccctcggtagatatcacatagtgggattactgaatcacaaataaaaatatttcctccatttgagtactaataatggacattaatttagcttttaaaatacttgaggtataaattaaacttacactaaatgctaccccaatgagtaaaacatttcacggttatctatcaataaagaattacgggctgggcacggtggctcatgcctgtaatcccagcactttgggaggccgagacaggtggattacctgaagttgggagttcaagaccagcctgccaactatggagaagcctcgtctctactaaaaatacaaaaattagctgggcctggtggtgcaagcctgtaatcccagttactatggaggctgaggcaggagaatcgcttgaatctgggaggtgaaggttgtggtgagctgagattgtgccactgcactccaacctgggcaacaagagtgaaactgtctcaaaaaacaaataataattatagaaagataatctttcttttcagctggaaacagtagtaaactgaggacttgagatttcagattctgaaaactgacttcctattattggattctacatcatcccatatgataaacttgggaaagttctaaaatcccaacacttcagtgttcacacccatcaagtgacgatgatggtggttctcatggggttgtgataaggactgaatggggtggtttaggaatagctgctggcccataatactcattattacggcgttgatcttccactaccaccagcaacgccactgtgaaaattatcatttctgggccagaaaaataagaaggaggggaacgaggactgttctgtcatagtgaacctaggacacaacctagcggctgtgttaatattactgtttctttgggagtttttccaatatccttttgccatactgatgactgcactagcggctgtattagtattactgtttctttgatttttttttgtttgtttgtttgcaatatccttttgcaatagtgatgaccgcactagtggctgtattcatattactatttctttcgggttttctttgcaatgtatttttgcagtagagatgattgcatccttcctccaagggcttgacatgtacttctgttgtttagtcttcccgatgtctgcagagctggcatgggggcatgatcctccgtcctagcatcaatggtgccaaaataagtatgtctgggcttaggaaaggagagacttcactaaaaatgatgaaggccgtagggagaatggtctgacctcagggactgcagggatcttaagctcaaacagaaaaaaaaaaaaaagggttttcttgtattgtaatggggaagcaggggtaggggtagcaggagctttgagcaggcattggttccgtgtatgggggcagttgagcaggaaagggtcctagcaacagttggccaatctcggcatacgttgctaaaagatgttctgaaccttacagcttgcttaacctcagggacaagcccaagttcagcatcctgttgtcctgtggggaggataggaccaagcccaacttcagcatcctgttttcctgtggggaggataggagactgactaaagctggaccaaggccctgggcaagttcacccagctgtgaacgctggaccaggcaggtcagccctggccctgactcctaggaaaaggacggccagagggacaactgtgcagacccacccaaggccggttgggcgtgaggggatgccctcaccccatgcccagataacagaggtctgagctgttctgaaaatcaactctgcgtgaaagatttgcatttgttacatgaccggcagagggtcttagcaatacgggggaatgacaacacagtcattgactagaggtagctagagctgctttaaccagttctttgagcctctttctccgctagtcagaaggaaggaaggaaggaagtgaaggagggagggaaggaggtaggggaaaatagagaaagaaaaaggacgaaaatagaaaattttcaattcaacctttgagctggcgtgaataaacattttcttcaaagaaaatgatggtaaatatcttgggctctgcccaccctgagttgctggtgcagtgacccagctctgcaattgcatcactaaactagtcacagacaggatgtagacaaacgggccctgttgtgttcttataaactccttctgtggacactgaaatgtaaatttcatacatcgtcacttgtcccaaaatcttcttctgatgtttcttctaccacttaaaaatataaaatacactcttagggtttccacaagataggcagtgagatttgtcaccctggccatggcgggtccatccctgttctggtctacaggctccttgtgtgcataacatgcccctcaatgcctggccaccacccctacttaatatcatctgggatgtatgcatcatctgccaagcagttgcaaagttggttggatagataaagtttcgtaaccctcacaaatgtccggagaggtaagaaaaatgcactccattttatgtatgaggagacttaagctcagataaattaaaaagcctccctgtgattgtgttcatagtacttgctgctcgctgctgggatctgtaatttgggcccttcccaaaagtctgtactgtctggatttcctgttcaaaggttgaagctgtcactggccccactgcaaactgcacatagtctcttcttgggcccctgacagtacagaaaattatcttaaatcacaagcagatgggtacctggtatcaccaaatagcaaaaactactgtttcccattgtttttaatattgtcactaactgaatgcttttgggtatgtggatagaagtgatcttttagaatttgaatttagtaagtcaaataagaggaacttactttattacacataaggaagataaagaattggacataaaaatgctcaataaaagagttagcaccaatagcatatttatcctttctttctcaagtcagtacagagactcattgagaaattttatggacttgccattggcttctgcattcatttaagttttatcaaaaccagagagaacataaactttgcacggccgttcagagccttcattgaaaaggagaaagcattttcaaccccatcaactctttagccataattaaaaagttagtaaaaagaaagattttgctaccaccccaaggatatcacagtgatcccagtccagatatgaaaccttgttcccacacccctcacacaacgaattgcctctgggtggtgtgaggcagagggactcttaatgtcaggatcggatgattattatgctctgataactccagccagccctattccaattccatttctgtaggaatctatggagctcatctgaggaaccaggccactgggtctgtgactccattaggcttttttgatgtttatcagcagactttggtgacttgatgattaaaatgtgcagctgcagaacacctgggctgtgcattcctcaaaagctcattcccgcacttactgggaacagagagggctataggatggcacttttttgttgtttcattttgccttatttaagaggatttaattgactttgcagctttgtgtattcccctttgtggctcttaatacacaaattactggaaagatccggggatcaatgacaaaagctgacacggaggaatgtttctgttgtgatttgacgaagtagaacactgttgattagaaatttgcttaaaatctgtcacgtttctttgaatgtgtattatgtcatcagctaaccaagagtgataaaaaatcaaaccttgtctctatctgaaaaaatgactcacaatttaaagataagaacgttcgttctaagacatggcctaagacttaacttttttaaccatttaagtttggcgtttaagaacgatactttcccttgtttaactagaaggaaacacatacttaccatattttcatttcccaaacaaggttcctgccaaacagaggcaagttctgatttataaagtaaaaggaatgtgatctacagcagagcattagaagcagcgtggctgtttaccctgcgggagtcatgcaggtgagactctaatgcgagacccaaacgctgatcttgctgctccaccccctaattcacacccggacttattcacctctctgctgccccttttcaacatttgcgtgacccagtcatctggctctgttacaaactgcaaaaggacaatcctgggcaaattatgtaaacagtcagtgcctcttttatctcatctgtagcatgggaacaatagtgcatgcgcgtcatgtggccactgtaggcattgcatgagttcaaagcacaaatcgggcctggaacaggacaaattctgcagcagtgttaggttctgtgatgaggtttatcactgcagaaacttgcagtcgtgtttctggagtagcattagggtagcccacttaattttcaatataacattttgtattattgtcaatagacttggaatttagaaaaatgtatcacttcaacaaatatttgtggactgtgatgcagctgacttggtatcaacaaatcagaaagctttcactaatttataatcgtgcctctctttccaacattcagtctttctcttattttctctgtgatcagtgatattcatatcttacggggatattagccttacttgcataaggtaggtctacaaacatgatctctttttccttgtacgtttttaatgagaattctcaggttatcaactaagggactagaatacaattccttttttaaaactttttacttaggccttttgtaggctcatgcattcctattgccaaagacctcacctcttggcccagctcacggcgttagaagcatagtgtcctggcttctgctctttctccacagtggctcttgtctgcacacagttttgaacttggggtaaaccattctccttccacagatacccattgattttcagctctttgaggcaataaagtggcatctgctaaatgcctttgtctatacttatacaatagattagagatatatgtcacaaaacatggacatttgcttgactgaatactcctggactacatcctttcaacttaaataggaagctgagaacagaaacatcttatttatttatttattttttagcattactgtttgccagaaactttatttcattgtatgcttacactaaccttgatattattcttcctgaatagatgtggcatctaaggttatagatctcctatcataggtgtaaaattgtatatctcaccctcagctgtcgcagattgtgaagccagactcctgactctttgctgtattttcagtgtttcttccaatttatttattacctccttaggaaaacaaatgtggcagcaagctgaaaatacggtgcaaaatgaggatggaaagctatcattggattctgccttctcagtaatttgctgtcagtaatgcagaaaacacttgaaagcaggatccacagtgcctcgttggctgggttagatgatggaatctgagatgttagtttgctgccatgagtcaggaaagccacatagctacggtcaccacttgcatgtgacgttccgtcattttttgtttcagacacaaatacataaaaactgtgtttcccctgacaaagggttttagagcacagggtcaccacactgaaaccgtgcccactgcatgggttcttatatctgtgggactgccggattgatggaagcggaaattccaggcagtgacgttatgagaaaataaaggatgtcagctgccttgcaaggtgaagagaggaaacagagcagggacatctcagggcaccctgtgacggaatgcagcatttcccatgattgcgtggaggccgctgctgacgagggaccagctggtgctttgtaattcaacaattgtgagcagaaatgtcagaaagactgggaagcagagctgcagaaccttatccactggctcatctgctaagtgcggggcacaggcaacagcatgaatgaggctagggaacctagaactgcagagtattacactgttgcttccagaatgtagaaagagacacagtcaagttcacaaaacggggcaatgtcggaagtgagaagagcccggagatgaactgagtcaaacttggacactctgtctttatagccgtatgtatcatttctggcatactctccagctccccttgggtgagttgctgagttagcggcaaagcaggaactgggctctgcttatcttattcctggcatggtcaccacagtcaagattcagtattcaatacaacattgccattttcctttacggctacattaattacacatctgaaaaagaatcatacccccttcaaaaactgttaataacacgttacaagtcattttacaattgtaataaatggtatgcacttgctacgagatttgttcaccttgtcatagcagaaaaatgaaggcaaataccatttctaagattttgagaagaggatagagtatacacctttcataaagtttttgagaaaaatcttaagtctaatttgatgttaatttctcatttctccataaatacacatgcacatacatacattccctactctctcactatacgtgtatgtgtgtatattcccataaaaatgcatgcatatatatttgattatatgtatatattactatggacgtatatatctattgtgtgtgtgtatatgtaaaggattttttttttcttttttgagacaaggtctcgctctgttgcttgggttgcggtgcgctggcacaatcgtgactcattgcagccttgacctcctaggctcaaacgatcttcccacttaagcctcccaaggagttgggaacacaagtgtgcaccaccatgactagctaattttttttttttttttggtactctctgtagagacagggctttgcagtgttttccatactccttggcccaaactgctgggctcaagcaagccacttgccttggccaaattgctgggattacaggtgtgagccactgtgcctggcctaagtaagggattttaaaaacattagtacataagcattcctgcttacgtgtctacctgatttctgtaaatattcaattcaaaaagctgatttataactggaagtagatttttaaccatcgtatttctatattaccatcatagagcattctcttgagaaagtgggaataatgttgaaagtgtatggtgttccttcttctccaaagatgtaagaactatgttagctacagttttataaattatccaatttcaaacaattatcgttgatatttttctatacaatttcctgtatattacccatataaatctggactttgggaaagttcttaataaagggaaaaaaattaaagcatagtcaaatgaaggtatcgagctaaacacattgattacgttaaaatgaccccctagcaaaccacaagcaggaaggattgtaactgcttacacctcccattgattttatgcaggcaaaacttatctctgctgatagacaaatggacttctctgccctctaatatttaatgtgtgcctgcaatagaaaaggtacatggaaatataattgattcatgctatatatataaaaaaacttcgaacaattatttttcatataaaataagcatttgcagaagaaatgtggcactaggaaaaagctacagtcttcctctagtatttacccgctgttaatttatctgtgtgagcttgaggaaatcagttggatttttttcacctataatgttgacataataataatgatgccacagattcttgataacaaagtgaaactacatgtcacaatccatgagaaacatatctgacaaggataacattttaattccccatgttaatttaatgttatggtataagtctatgataaagtttcactaccaaaatcttccatttggttcacttctgtataatgtgtttgttaaactagatatgggtgattcaatatcttattgcaattacaaatgtctcagaatttatttatatttttaaagagtatttttcttggtcagcaggatctagaaactgaattgtagttaatgtctcactgtaaataagtgatttatctcttgaagcattgatcttaggatctataacaaggcaaatgatttacacatgcatggtctaaagtagtctgaatattttagctttccaagtaaacttcaccgtatttatacttgatattacaagaagaggttatggtaacagaaaggattttgcctgaattcctttgctttcaaagattggctcttctaatgtatttggtgaacagggatcctaatatcttctgctgggagaaggatgcaagttgcaccctggcaccacccgtaaacttagctgtaggctcctcaaccgttttattacgtctgcatatgggacacaatttctcttgcatcatttctccaaaataatgtctagtcctgtatctggaagacttttactgaaagtttggacgttgcagactgtaattaaagcacaggagagggaacaaaacattgctctttctcaggcgtttctcagcaggacatttttttatatttataatccatattgttaaggttattctgtccctccctgtcttctcccaacacctctgcaagtgcgcaaactacacatttaaatgatctttttagataaagcaggttggtttttgaaattcctttttaatctgcattctgaatctgctttccacaccctaaggttctaaaccaaatgctaaacactccttatctgcaccctaaccatttggaaaactggaagaatattggaattgcagttaatgcttgttgtttggtttgtttgcttgttttacctgtacctgagttatgaatccttcagcagggtcatgttaattcattacacttggaagaacagaaagagaaattctgccttctagaagatatctctgttgtgaaaaattctgttagctgaagttctaagccccggtaaaaggcactgaagttgtcaaaagcctgccatccaaagataagagagtccacattacttccaaaggtagccaggcacaaaagacagctgcagacactgagttagaatggcacgggttagagaatttagagatgtccttcctaacagggagctgaggaagcttggagacttctacatctggggaaagggaatgcaggctggagggaggtgcatgatggaaaaatggccctgttttcctggggccgatcctgtgactacaagacagatgcctcaggacatacctggattttgtctatcctcaagatatcacagtttattccttaaaatacacaatgtggaaaatacactcccttaaaaaacaaacgagttcattttacttacattaacttcttcacccacagcaacacgtgccttttacgtgcagcgttgaggatattttaaaggcatccatcagtctctctgacttctctgtgacagtgctgaactttgtgtaccacatcacagaatttcctgttgttcacaatttaacaaaacaccaagaggtagattactgaacattagagtggacctgggtcagcttacaaataatcattatgcatttaatttataaagagaatgaaccaattaaagtggtattttaataggaaattctcaagtgaccttccctgaagcaactacgacacatccagcaaggcctggctggatgcttggagttgaggttatttggaaaatgtttctgttggagctcagcatcactcagcattgtttattccttcagtgtagcacttagcatcctccattctgtaggtgttgagctaggatgattctacagacagaaggaccagttgtttatttcccttttagcataaatctggttcggattttgatctgtacttagaattaaatatttttggttagtattgaaatggtagttccctgagtatttacagtcaagattccagatagagtaatccttcaaatatattggaagatttccttttattggcccttatgtagaaataccgttcaaatattgctcagagctatggcagttaccacctaagatatattggttttattataccaaagtgtatctttttagaaatgcaaactggagtgatgttttaaaaattctcagtgaatatgtgaaagcttatctttactttttttaggaatatgaaaattacgggctgggcatagtggcttatgcctgttatctcagcagtttgggaggccgaggtggacggatcacctgaggtcaggagttcgagaccagcctagccaacatgggaaaaccctgtctctactaaaaatagaaaaattagctgggtgtggtggtacacgcctgtaatcccagctacttgggaggctgaggcaggagaatcgcttgaacctgggaggtggaggttgcagtgagcaaagattgtgccactgcactccagcctgggcaacaagagtgaaactccatctcaaaaaaaaaaaaaagttaatatgaaatgtttaattacaggtgaagttaggtagtctgaaaagtgcagatgatggtgaactatgttgggaatggaatgcaggctgtgtctctcgaccatgtgccatctttcccaggacacaagccaaaggcagcatgagggactgaatcatgacatcccttcccaatgcacctgttgaaattctaaactcagggtgatggcattaggatgtggagcctttaggaggcaaggaggtgatgagagtggagccctcgctgtgggctgagtgcccttactagaagagacacgagggcacgctcctctctctgccatccacaaggtgaggattccaggagcagctactgtctacacacaaggctctcaccagaccagacagctggtctcctagagcttgaatgtctcagcctccagaactccaagtagccaatgcgtttttttttttaattatactttaagttttagggtacatgtgcacaatgtgcaggttcgttacatatgtatacatgtgccatgttggtgtgctgcaggaattaactcatcatttaacattaggtatatctcctaatgctattcctccgccctccccccaccccacaacaggcaccggtgtgtgatgtttcccttcctctgtctatgtgttctcattgttcaattcccacctatgagtgagaacatgtggtgtttggttttttgtccttgtgatagtttgctgagtttttcattttgttttaaagttgcccagtctatagcaacttataacttacagttagttatagtggtcccagctgacttaggcaggagctgttattgactctaagttgagcttcacccagagcatgtcacgcgcatcaaagatgccatctgtgttatgtttttcaagagaaaagtcttcctcctgcttgtatatttctttaccgtaaaggtcatagaacagactatgggaaacaatcatggaacccgtggttttaagacctaacctctactcagggctttggtgcatcttctgtgggtttctacctggtgcaccccagagtttgtgctgcaggagcctccgaggctttgagaagaatcacatgcagcccctgattccatgaagctcagctaccatttccagaccagagaagtctttctgatgatgtgtcttcctgcccggctttggagtcggcacattgggtcaggctctgatctcacatggcaagtccatggcttgccgggggttgttaacctaggtgagcttcagtgtctgcatctgaaacctgaccatggtgatgtcagatatttcaaagaatggggttcccatgagccagcactcagagtaaccttcatgcactacatgccacatgtccagctgcattagggaaccgatattatttattagggtcattatcattatccagaaacaggtttatacatgactaattaaaatgcctaaggaggagggctctaatggagacaggaacagattgtggtgggagcacaaaggcaatcatgtagggtattgaaatgaggcgtgggactttccagaaggtaggtggaaaagccattctagacagggcagcatgtggggaaggcagtgtggaggagagcacagccactgaggactgagggaagaagggtggggcgcaatagacaggtgagcatacagaaggcttccccttccccgctgggaactttgtatggaattacgcaggtgaggaggagccgctgaaggattcgaggtaggcagcagtcaaatcatgcgtgctttctttttcagtagttgtgtgagggagtgttgcctggtggtgggggcagggggggagagtagaagaagaatcatgtgagggtaactgaggaagagattggtcaggaggggatggttctaaacagtcattggagtgaggacagctggagttagggcaggagggtgaaggaaaagcccagaaaacccccgatctctgactctcctggcctctgagtggatggacaggaagtgctggcggagctcttacctgatgaagatgcctgatgccggtgaggtgagttgacttccttaaagttcagtgtgtctggccggtgcggtggctcacacatgtaatcacgccggcactttgggaggctgaggcgggcggatcacgaggtcaggagatcgagactatcctgcctaacacggtgaaactcgtctctactaaaaatacaaaaaattagtcgagtctggtgccgggcgcctgtagtcccagctcctctggaggctgaggcaggagaatggcgtgaactcgggaggtggagcttgcagtgagtccagatcacaccactgcgctccagcctgggggacggatcgagactctgtctcaaaaaaaaaaaaaaaaaaaaaaaaaaaaaaaaaaatgtgtccatataaacatttagacagataataatggagcttccttccctggagttgtggtgttttaaccagagaacacacactgtgcacatcacaacgtctgaggaactgggtaaacagccttttcaacattgttaactctacacttactgctgagacacatcctgggtacacgtctttggagtctgctgtgccacattatcaaccccgaattgccagctctgcaagtcgatgttgggctgaagcttatcagaatgaatccacctgctttggatgtgtcagacaccaagcagaggctatggcactgtgccgactgcactacgcgaattactgcctcgagtggatgagggtcctgggagaggttttctccaagttcatgtttccaaacgatatcaccctttttttgagaatcgacttggccagcggagtatgaggctggattatatgtcacccatcatatgtaggctctgaattcctcaccgactgccattatgttggtgtgtgggaggcagatacatgcaattgcctccctcaagtgtctgcaatgttgctaagtgttcactccccaacagattttttttgaatacctagttagtgcagggtacaaaatttgcaccctgtctacaaatgacagcggtaacaagaaacagcgtggtcagtcttacaaacaatggggccaatcatgtgccaagggatgagcattgagcaagacatgattttgaaaactcaacaaattcaaagctggtgtgaacggctctgcttcctggaagccattccaacccttgcattcctcatacagaaaaactcttcatggtgcgagctgacgcagaacctgcagggaatcagtgttgactttggttccttgggacaagtcaaatatatgttcttcattaagaaatgcggaatgtggccaggtgtggtgttgtgaggctgtaatcccagcactttgagaggccaagtgggcaggatcgcttgagccgaggactttgacactagcccatgcaacatggtgagaccgtctctccacaaaaaataataacaatgtaataataaagaaattctgaatgggattcaagatgacaatgtttgagggtgacagggctcacatgccgtctagtttaccgtatatatttcaatacaaaaaatatatagtaacctgtagattaagtcacttttcccagattaagtcacaattgcccaaagaagactatagtatataatgtttgggacatttttccagatctttctgacatattggatcatttttttcctcaaaaaatggtgagtaccataaagttctcaacaagaaagcattggaagtctaactctacaagttccagttatacctgtccaggtcatgaatgtcctatttggaaaagaggatctgtactcaatataaacacgtactagtgttttagtaattgaatgaatgggttcgtgccttttattacatgtgtctaaactattatatctgcgccatgtaattatattcttaaccaagttacatttttaacatccttaaatctttgtattttagaaacatttaaaaatattttaaaagcggaaaagtagaagataattattatttatataaagtagagaacgttttatgaaacaaatgctatcctcccttctgttttcaagttagaaatgatttctggggtctctgcttcactccactcactgatagagtctgaaagcctattttttagttctatttcagcttctcccagggacacaattcccctggttccctgcattgtgaatgattgcgaatgttgctttttggtgatgcaactcttactgacaacctggtaaatccatcattcctgttctcctatgtctgagaagtctctagaaagttggaagaggtcaatgaggaaatctccactctttgccgagtatgtaaaaccgcacagtcgggacatagaggtcctgctgattatctcctgataaaaagaagctccagacaaacaagaacaagcttgtcttcacctcttttatgacttaacagtagctgagcaatccagataacaattaggagactctaaccagattctggagggaaggggtaatgaggtgaagcatttagactggagccctcaagcggatatccatttgcagaatgggatatgctcatggagcagttgaaactagagaaatgtgattcttcacttcagatttttcctggcaaaacagaaaagataaattaagttctaaaaacacacccttatcagaaaattacagaagaaagaagagaagtagaatgaatatggccaggacatgtttaagtggggtatcctgtttaagtggggtgagtgtgaggcagaataaggtcttgaggcagggaacttacggccagtttgtgctgaatcaaggaagaagcccaagatctaggggcaggaggtctaaggccaattcgtgctgtcttcccaaagctgtatcagaagggaaacatctgggtctgggggcagggaacctaagcccaattaactcaaactttctaaagttaatggaaaggaaaaacttccgtctccccatttcctaacaacaaaggatcaaaggctgctttctctatagccctcctccttccaccgtgtctcagatggaaagggagagtgccttggattggctatgggccaagcactggccatcccttcatctgcaacacgggccaattcaccccagcctttaattagccagggaccaaattcttcatccagataaggggtaactgagagggacctcaaaataagtacttaaatcccagaaaactgtgtaactaggccctggaacagcttgcttgggccccctcccaccctgtgaagtgctttctggctttaataaatcccccctttcacagcttccttcctatgtttctttcctttgttactttgtgtatcttatccaattattctaaatgccaagaacctggagaactcacagtcaatgctctccttccggtatcaggtgtaccctcagagtgccatgggcatcacaactagttaaaggggttgacaactgtgggtcatatctaagccttacaagtatacaatatagatttgatataaacttaatatcaacttcttctttagtttaaccagctttaactatgagccatatattaaacacctcctgtaataaaacaaatttaccaaaggtatccgaactttcagcctgggttccacctaattaacttagtctgtagcaaaaaaaaaaaaaaaagggataagacgtcattatatttcagcagcccatgaatcagatttgaagaactggaaataaaaagcaatactacaaagctgtggcctgaaggagaaatttctttgaggacaaatggaaaaagatagtgctaaccctataagagggtttagaccacaccgttctgtggacagggaaacattctcagcacttacctgttttgaacactcacatttgctagtgcatttgtttctctagaaatgctaattccaatcctccatagtttcccaagttaatagatgaagatatcatgtcactaaacttgcttcattgtgttcattttgtttgtgtgattgggttggaattggacactagttcctaaatggagagcattttttttttttcaatcagtttgaaaactaagcatctgatagtttctgggtatttctgtttatgatgcaaatacttcaacatatgacctaaaaataatttctcctattgtgttgtcagctactaatcatattatcaaatgatgatattagaaacagcacaacaatttaagaaatcattttcctctgttaggcttttaaaaataaatacgagactttgttgaagcctgttttgcactaatgaagtgattggcaagttcaatgtaatctcacgttgtgtcaggtctggcctctaggaatgccctaaacctcagccacccaataactgcaaagaagccacggccagaatcagttactgttttctctctcatttgcaattaaatacagagccagtgctgctaagctagcaattgaaaaaaacgtgtttttctaccatataataaaaatggtcattttagtgtctgaacatgttgctaaacttagaattcatctagaacagctcctttttcacgagcttgtgaatttagcaaataacaaggtagattattctcagaggagtagagggaaactagttctgttatggtagcaggcagaaatattgacccaaagaaaactgtcctctccctgaggcctctaatatttgcctacagccaaatatcataacctcgtagagtaggctaatgaggtggataaagatagcaaatctttgggagcatgaaacattaccttataccaagagtagaaggaaaaccctgttgtattagtaaattaagtatcactataatttggctaaatataaaaaatgttttaatctggtgattatcttgagtcatgatggtattcaccagtatcatttttaacatatgttttacatatgtggatatctgctaacaaatgttgcttcaaacattagggaatgttccagtatggagttatttttttttcaacttatatattcaaacatttaaaacatctttgaatatagaagttttggaacatcattgaatatataagttgagagaaatttaatgtcataatttataaacaaattaacaccatgatgttattttggatagcatagcaaatatcacactctaagaagttctcatgttttctttcctccttgtaggattggtactctcaatatctaaatggtactgttagtcacgataaatgatgaattatatgttcagttagtcattgtaaaatagagttcacaatatgtttcacttctgtgtattgtcgatggcatgggatgaatcactgtatccgtttttagttgcaagattattagatcagaattgcctgctctccaaaatttaagcaatttctggagaagtttagagatctggagatttaaaaaacttgtgaattagggtgaaaatatagtggaggaatcgttacaactccatttcttagtacagttactcgttctgtacaggtttgtaagagcttcttaacccctttgtttgtacatgtgtgaaaatgtagcgaataactctcaggattattgtgaagaccaaatggcatattgtatacaaaagcagtgttaaaccgtgaaatgctatctaaatgataggtatcactgtgtttcctttgtttagccaaatctttctttagcttcttggtattcttggagcatacaagcttcatgagcatacttctctgaacagtagtagcttcatttccccttaatttccatcttgggaattacggatttttcactacctgaaggtcgctggaatttcagcatcaagcttattcttcagtatcttgtaaatgtgaaggtttccagtctttctgatagatcacaaggctgggaataattttttgaaactgtgagagacacgttctgttacttattggagctctcttggaggaaacataggtaagtgagacctatgagatctgaaaatgggaagtttgtagatttgggggatattttataatttgttagaactaaatagatgaaacggcaatgtttgtaaggaatattacctgtctttctgtctgcctaaatcttttatgttttcttcccatttattgagatacgaggactttttgttgttggtgttgaagtttttgttagcagtaagtcggccctactgagcctgtgcattggcgatcagcaatctcccaaatgccctcttgggcagagatttgatttgaaacctggagtgagggtgctgagcccatttacacgcttagaaaatcaaaaccaccctaggggagagcaaagctggaggggaggagatgaagatacttagagtggggaagacttacagattgtccagaacaccatccatgggttttctactctattattattatttttaattgagacagggtcttgctctgttgcccagcctggagtgcagtggcgcaatcatggctcactgcagccttgacctcttgggttcaagcagtcttcccaccttagcctccctagtagctgagactacaggtgcacaccaccacactcagctaatttttgtttgtttgtttgtttgtttttgagatggattttgttgcttatactggagtgcaaatgtttgatcttggctcacggcaacctccacttcccaggttcaagcaattctcctgcttcaggctccgaagtagctgggattacaggcatgtgccaccattcccagctaattttgtattgttttagtagagatgggatttcaccatgtttgtcaggctggtctcaaactcctgacctcaagtgatccacccgccttagcttcccaaagtgctagatgacaggctgagccttcatatccagatgaatttttgtttatttgttttgtggttttagatacgggtttttgctatgttgctcaggctggtcgcaaacccctgggctcaaggaatcctcccgccttcacctccaaaagtgttaggactataggcatgagtaactgtacctggctattgtcttatttttaataatcaaatgtgtcttctatccttccaggcaaattgaggtcagggagaactatttacctcctacctgcaacccctgcccacataaacatagtttcacctgcccttgctgccatccacacttccttttatccatcctctgaagatgaggtgtcctcccttccacccttgcttctgatgaacatgctgatctaaaatttccatctgatcactttgttcttctgctccaaggccctctgtggaatgtccagtaagcctgtagaacactgagctcagtgtgcaaacatctaagtgattgtgccctgctgggttctttgtactcatctactcaagcatcactcggggcttcccaccaaaatcatcattctaacatttgcaaatggcactgtttggcatccctttgcccttgcatctgctggtcccactattccaaatgcccttcctctgctccttgtccccttgatgcccactcagttccataggcagctcagggagctatatgcagatcgtcgtgcaggatgagtgccactcccctgagatccacaacactgaatgcagaccattcatccacgccaccttcctcactggactgtccacgcctccagggcaggcatagagtcttccttcgttctttacctccagtgcttagcacagcaatgttcacttaaaagcagctcaaacaccactgtgataccctctacctggtcaaaaaattttcattacgtttgtaataaattttcgtataagtataacgacagctgtaagacacagggtgccaattatgcaacactttacactgatgcataatgaagctaaattcgcctttaaagcaccactaggacactcttattttccaggaagatactgaaactgaaacagtttaagtaaagggtttcatgtgataaaaccagtaggaaatgggtccaggattagaatcacaggggtcttcatgtgtagctgtgttgtggtcggtaaaagacattgttgctctgtttttggtggccccaagtctgtctcaggtgctgaaacatgcagcatatgtcctttctgcatgtggccgtacagtcaacccacagctcaggaaagatgcatggcgagtgttcgacaatgtttgttaatattccaaataaatagaagcttgcaggactggattaaattatttgtattaaatataaattaaccttcctattaaataattcacaatatattaactttattctctatagaatttgcctcaggggcaaaaaaataccattaaatgaaagccactgttcatagtgtattctgataattaaagataactagttggtttagtatttttcctctagttaaattggcacttaaaaaatgaagaaatattgaattcattacaatttaactttgaaaaatagaaataatactttgaaaagtcaaccttaagagatgttttttcctttgtttaattttttttgttttgctttcttgaatttctaagaatctaggatctgatccaggggattctttcttagataaaatagccatcactttcctcaaaatatgtctcctgagattttgtacatttttagtggatggaatgaaggcacttgtaggcatttcctcctgcgttctgtgtttttttgatagaaggtgtttttgaggctgagagctcagaactggacgtaaggaggcaaagtgccagagcaggtatcagaacactgactccttgccccagctttgccacaactcaaatgtgtaaatctcaactctgaagtgtatgattctgaaacctgcatcttgccatttagtttatggcatagccaggagaaaaggaaaacccatcagttagagacctgaaaaaaaaaaaaaaaaaaaatgtaaggctgcgcctgtaatcccagcactttgggaggcccaggtgggaggatcatgaggtcaggagattgagaccatcctgggtaacacggtgaaaccgcgtctctactaaaaaatacaaaaaaaaaaaaaaaaaaaaaaaaaaaaaaaaaaaaaaaaaaattagccgggcatggtggcgggcgcctctagtcgcagctactctggaggctgaggcgggagaatggcgtgaaccgaggagatggaggttgcagtgagccgagattgcgccactgcactccaacctgggcgacagagcgagacttcatctcaagtaaataaataaattaattaaaaaaaataatgtaaggcatccaaaaggtaaaataacactaactgagtttctgacataatgtaaggggaaaattaatttggattataaggcttagattttccttgagaaatttaggaaagtgtaattttatataaaatacaacatcgtgaaatacagtatctttatcgatgtgatctcttgtcttacagctatataagaagttactttcagtatgaatttatattgaaactgcttataaaaatgtgatcaattaacagttgtcttttttgtatcttacaaaccaaccagttccattaacatcaaatcttgtaaccatcaaagaaaacataatacaaatggaatattaaacactaccataatatttttaaaaggaaaaacaatgttatattctgtagtgaaaattaccttttaaaatactctctattttgacaatatatttaatttcattattaaacacaagcgataacttttgttttctgttcttcattaatctatttagcataagaagtttgcattctctattcaacatgtctgagttagcctgcaaggttagcctgagtgccactgacacgtcctattttgattaaaattagaccatgtttctttatcaatttctcatagctaccagaaaagaggcatcatggagaattaattaaaggcaactgtttccaggcaagatgaggctaatgctattaggtaggaggaaatggataacctatttacagcatctgttatgaatggcttattctctgttccacattttgaaaattctcccaaaataagcagacaactaagggaagtagcaaaggaagttagagcccgaaaagccaaccaactgtgatcatgttgtaaaaatacacagctgcttggtttctcactgtgcccacatttatttgtttcattgatataggctgaatattggttttgatgatattttaatctagtacttgggagaaagagtggctgtgactgttttctttgttaagtttctgttctctgaaattcgtaaataatcacaaagcaaacctagagtttgtcaaacatttggatgtcaggatcccttcacaatcttacaaattattgagtccaacaaactaatcattataaaagtcaaataattcacatgcacacctttcaagagccgttggcttgatggctacataagatgttacgtagtctctgaagactcacagcacacttgtgagacaataagaggaaaaaaggaaaatgctgtctcactatttttatggaaatatattcaacctctcttgctggctggaattggcatcttctgaaatactgtaaattagaggcattttgcatcttttgctgagagtcattgaagagcatgtttgctattgctgtagtggacagtaatataatagcatccagttctttggtttgctaacacacagaggcatttttcaaaagggatgcttgctgagaaccagttttatgttatttatttcaagggaccctccagtcaagttgcaggcaggcagcttcatttgtgctcagcgatgaatattttattatcactaacagatcaagatagtgataaaatctggaagctaaaaaaagatggtccctgtgtgttcctgactgtgttcaagttacaatctgtcaagtctggttcaatagttcatttctatatatgtgatcaatttttgtgttcacatagctgttcttttgtgtatatcgtatcttttctaagaaaacagtatagttatagcagttctttttgagaggtcctttggaaagtttccttcaaaggaagtccttttgctgagtcagttcattttttttctcttgccaagtgccatttaaaattcttctttggtttttacccataatattttttgaaattgaattcaatttgtgatgaaaatgactaggacttccacagtatttgacttaacaccaatagtttagaaagcccaatccagggaaaactaacatatgctaaataaaacatcccaaatcattgcaatttatcagaacatttttcttattagatttaaaaaaatgccaatttgtagttacatctatcccattgtttaaaaatggatattaactagatttttattcctatcattaatcagtttctctttctagtttacacagcaattctttaaatgataaattggtgactgaattatattattacaataataatatcctgactaataagcaaaatatccaaatattttggtttcttcttcatatattatcccaaacatctttgaactattaacagtgcaaactaaattttcctcttgatattttaagaatcaaaactcatttcttcttatttaatatttgtttccaatctgaaacataactgttttttctcaggctttcctaaagctttggttttatatgtggggatatttagtgtgtaagttatattcattttgcttctgataatttccgtccttccctccttccccttccttccccctctttccctctttccccttccttccccctctttcccactttccccttccttccctcctttcccttccttccttctttccccttccttcgctcctccctcctttcttcctttcttctgtcttccttccctccttctaatggttgttaaggaaggcattagacatgaataaatatattcccatgggacagcttaattctcaacattgttggtcctgaagtgataaatggaagcctgtctaatgaaaattttatagtgattgtaccagaatatgacaatattttgtgtgcgtcaagaacatttatgcaattatttattatggaagaattttttttcattctatgtgaactcactgtgctaagagtttaagaaaggggtctatcctctcacaaaataatcaataaaaattctagaggcagaagagaacccagacactaagctgagcctgcctagtatacaacagatgtgttggttgaggaatgagatgaagagtttagcaaaaactagataattgaaagccttccgagcaatttgtgtaactttattctaggagcaattggaagctatcaaacgattttcaacagccaaggccaaggacaaaatttgtgttaaaataaatcactcatgatgccgtgttgagaatggctcagaaggggtatattggagacatgaatgtcaggaggagactcttgtagtaagaggtaagtggtgtggttcacagaaatcaaaggcggtagggatggaaaatttgaatgattctagatatattttaaaggtagaatcagagaatcaggtagcacgtgtgtaggtgtgtttgttggaagttgtatgcattccttagggctgccataacaatgtgccacagactaggtggcttaaacaacaagagttatcttctcacagttctggaggctggaagtcggagatcaaagtgatagcaggtttggtatctcctcaggtctttctctttggcttgtagacacctgtcttctccctctgtcttcaaaggtcatccctttgtgcctttctgtgtcccgatttcttcatataagaataaaaatcgtcatggatgaggacccaccttaaagatgtctttatagcttaatcaccaacctaaaggctttatcctcaaatacagtcacattttgtggcaatggcatttaatatatcagcatacgaactctggggagacacaattcagcgtgtaaggacagtgactttccttcaactttaattttaaatagtcaaacatacacatgagtttcaatgtcattaaatcataaaagaaaatttgatattcttataccagcaatattgatgttgagttgataatcttataataatagcaattaatctttattaatagctaatctcatttaaatgtttaaaaaaatgtatactgaagtattatttctcttcttttatggataagaaaaccgaagtttaaaaatgtttgtttgcatgacctgaaaaagaaaacatcaagattttattctgtttccctggataactatgtttacaagatttcttataaaaaatttcctgtctttatatgtgtaaccctgattgcaaagcaggtgtgtgtttcagaggagatcaggcatggtcagagtggcatggctatagataagggatatatttaaatcagattatcagggatataaaataataaaaaaaaccataaccataaacagtcttgagattacactttatgtattatggtgtaaaaatgtttgtacatattttccctacacttacatggagattttagagttttcctcttcgcattgctagtacaatgcttagcatgaaagatgtgtttattacacatatcggcgttaatgcacggctttcctacaaaacccttataccatgaggaggagaaggaaaagtagaatatgaggaataattgcagggcaggcttttcttctatactagctgatttggggctgaaagaaaaataaggtaaatgataacatttatttaaatttatgttaggaacacgtcacagaggtgtgaaggtatatatgttataaagtgtcactttattaagctttgtgaagtgcttaccatgctgagaagtctatcattatttgtcctcattccagtataaacttagacttttaagcaaatcagttttattgaagtctttgcttaataatattattagatgtttaccagctgggcatggtgactcatgtctgtaatcccagcactttgggaggatgaggtgggcagatcacaaggccaggagtttgagaccagcctggccaatatggtgaaaccccttctctactaaaaatacagaaaaattatccgggcatggtggcgtacacctgtagtcccaactactcaagaggctgaggcagaaaagaatcgctttaacccgggagtcggaggttgcagtgagccgagatcgcgccactgcactgcagcctggataacagagcgagactccatctcaaaaataaataaataaataaatgacttttaccatagtcttcaggatttgttaataaaagataatctttctagaaatagaataaatttcatatatcctagttgtcttgagctacaaactgtctatcatctgcatttatatcaattcttctttacattcacacacagtttgtgtctttttaaacggattgtagagaacatcaacactatctctgcaacattttgattcacacatgacagcggaagtgcgtggaagccccacattgagttgcgaggctcatcaggtttgtcatgagttgtgaagatagaatatttatttggcttagaatgaatgccaaacactgtgctggaatgaattatcagccattgatgatgtatgctatagcacaaagggccttatttattgccccctttgcattttaaaattatacccagaaacaggggaatgcctaataaaatgtattatactacccatgttcctgttaaagtaaaagttaaatggaattttgttcctttaaataaaaatagtttctatgggtaaacatcattttcagacaccatactagagaataggcacaaagtcaagatgtattctacaagaaatacagaaaaggacatttatattctcctttgtgtcttgctcagtctgagtttaccttcagagaataaacatcaccttggataaaattttcataatccagcagtgctagatgttagaaaggggtattactaccccgtgaaaaaaaaaaaaaaaaaaaaaaatccatgacaaattttacccgcataaacaaacaggcaacagctgatctgtagaaatgtcgttcttactgtcaagacagactttggggatccatatgtgattctttacctgtttttgaagaatctataatgctttgcttttacctttgttatgccatcaagaagggattctgatagaaatagtcacagggatcacgaggtcaggagatcgagaccatcctggctaacatggtgaaagccggtctctactaaaaaataccaaaaaagtagccaggtgtggttgcgggcacctgtagtcccagctacatgggagactaaggcaggagaatggcgtgaacctgggagatggagcttgcagtgagccgggatcgcaccactgcagtccagcctgggtgacagagcgagactccgtctcaaaaaaaaaaaaaaaaaaaaaaaagtcacatttgtatactaatttaatcttgataacaactgcattgttctgatagtatattttttgcaagggatgcaataaatgaagtctatctaacattttaagttttatttacttgagaactagtcaagaagctgtacctattctcaagtgtaaaactaagcattagggactatgcagtttatcaatatatgagaaaaatattttctacagttaaagacaaaatgcgttgatattaaacataatgtttagtgaatatccaaggggaaaatatttggtttcaaacttttattttttaagaagtttaatcgtatatttgacctcaggggtagttgagagagaggtggtacaaatagctcaaggaaggcttaagggatgtgattagaatattattttgaggagcgtgtaggtgtcaccaagtggaagatgaaagcacagtcagacctcacattacaggaagctctgtgtagattcagcctcttcagttcctacagttcatctcctacctttctgtactcagccacaccacatgccgtatacttatagaaatggcgtctctatttaactatgaagtcttttgatgtactactctcagtcttttgtctaaaatctacattatgattataacttgtaaatgaataagcagtggttctccttttaacagcagttagaaatcacacttctctgaggcatttctaaaaaggattaggacaaatccaatcacgcttgagccagtggagtcattaatgctagattccaacagcagggagagacttttaagaccaaagtataatgttttctattttatagattagatatgatattcagaaagcctgaataattaatccgtccatccaatgcattgttctacctatctcagcatatgaacactctttctaagttaaataatatatatataatatagcacatagtacaatattatatatacaaatatataatttgtaagcattgacagattttgttacaaagaaaaatgttaaccacctcaaaatcttcctttgagttgatagacaaaatactttcatgtgttatctactcccctccaaaattccactaaaattacattataatcacaaaatgattacttcaaagtcacaagttcacaaggacaaattaaatggtagaagacaagagcgtaatacaattttgcaagttagaaaacataaggtcagtggtaattgatttaaaagaaccaggaaagaagaatcctaatgcaaaacttcagaaagccaagaatcaaatcaactcgcctcagggtacactcaaaagcttcagcaattggcagaaccagaaatttttgcactaaactgaggatgacggtgaggcagagtaaaaaagttgatcaaaagtatattttacaaggaattaggatcaaattccacttccattactgggggtctttggaatagaagaccttaggcatatttggggattataccagaataaagatgttaaactaatcgtttgcatgaatatagacatccttggctctccaaacttacatactagactgacaagaagaaagtgagggaccctgagccactcaagagaaagaaagaactaaggaaaagatgttgggtctttttcagtaaaataagcaagcttgatttactgacagtgactccatggtgatggagcagccctagccctcctctcacacacacactcaggaggttcgatcattttcttctaatataagcagactgccataaaaatcttctgacaagaaaggcaaaattcccaataaacacatagggtaaagcaactgggaagaaactgaaaatttgcaagatataagaacttaaatatataattgttaaaattacctgagaagtaaaaggatatattatattcacaaaacaagaacagaatgctatgaaaaagcaggaaccatctaggaaagaaaaggtgtcagagacaacttagaaaataaagttggagtaacaaatggagaaaattaaattgttgaagaaattttccaggatggttatttccagattgaaagggcccaagaaaactgaatactgaatgaaaatggacttgtataacaaaatgtcattaggtgatttcagaacattgggacaaaagagaatatcctaccaaatttccagagaggaaacaagtcagagtaggtcagtaataataataataataaaaaacgtaaagtaaataacctaaaatattctgatggaatccaatctcaaaatcggattcctatgccctggcaaaatgtcatttactcctagactttttcacaatacaaaacttcacaatttttatctcccatgcacctgtctcagtacatctacctaaaagaggaaattagccaagaaaggagaacatggtgtgttgggggtggaggtggtcaaggaaactgggaatgcattcaagaaggttcaaaaaatgaattcccaggctccacatgaaaagagggagaagataatgactgtgctagttttgttgacagcagatctgaaggctccccaggagacatcctcagaagaggaaattgataggaatctgctgaatttgaacatattaagtgtagatgttgaaagtggaagaagaggttggggatgtgttggtgataagtacagatgaaacaaaagcaacaacaacaataaaaattctgttttttttgttttgttttttttttttttttttgagttggactctcactctgtaaccacgctggagtgcagtggcgcgatctcggcttactgcagcctctgactcccgggttcaagcaactctcctgcctcagcttcccaagtagctgggactacaggcacatgccaccatgcccggctaaaacaggaattcttaaaacaatatgagttgtacgagacagaaatattcatgatacagcgcatgcacagagcctgtaacacttaccaataatgacatgaatcccgaaacttaccctacttgcactaggatataagtatccagcaaggatgagttgatggtgtgtgggtgtgaggctgtggtgtgtgggatgaaagtataagtatccagcaaggatgagtggacagtgtgtgggcgtgaggttgtggggtatgggatgaaagaaagaagacatatttccatgtggagagctaaagcttcaagaggaaaaagcaagcatgggctttgtaacaatggtctttgaaggtttggagataagctaaaagagatgagatgtgttatctgtaaaaatagaatataggagggggtttgagtaagcaatgtgtttgtttgtttggttgttttaaattttaaaccttggagagcatgtggaatggcatatgtgcattcatagttgtcttgcaactttcccaatagagtcatcacagatgttttagttccaaatcgaaggtactgtttaccatccacataagtttttacttggttcacgttcttgtctcctcattaaaaactgaccctaatttgtagtaattcacgagtcttctcagatcattcttactcatgcattcctccacgggattgcacctgtcagccatgcagaaacatgcctttcaaggaggagctgctgttttctcagggcactttttccgcaggggtccccgaccaagagtgcaaacttttctccagaggtgggggtgggagtgctggcctgacagtgtttgccagatgcatgtgaagactgttgaggaaccattttgaggtcttgtccactgctcttgagatgttataaatcacctgaagaatataaaatgtggtacttgctcaagtgacagcatccctttcccaaagcagtggcatttaccaatatcacaaggctttgcaagacagaatagtgtttaactgtgcatgctctggagtcagagtacctgaatttaattctgccttcaccatttgctggcagtgtctgggtttcttcatctgcaaaacagtaacaataataataagaatgataaataatgatagtacaaataccatctacttcagagtaaagattaaatgagacaatatatgtcaagacttggtagctggcacatagtaaatgctgaatatacctttcttaaatttattcatcatgactgcctattatttaatatcttccttataagtagtctaagtaaagggggtgagtggttctaatatgcatacaggtactttgggtgttgtatgtggtgtgggaaagtagaaacaattagaaaatccctctgtggaaaggaaggaaaactgactaggaaaaccaaagggtttctggtggagggagaagtctgcagttgaagttagtttttatgattttcttttttttttttttttttttttttttcattaatgcttggaaaactgtgtcctttcagaaaaggtggttggtttagattttccagattggagattttttttcaggtggctgaagctgaaggataaagaaggaagggagaggcttgtactgccagaaagaaagaagtctagaataagaaatctgaaaagcagagggagccgcatgagaataacctggagcggggcctgtagtgttagaagctttccgtaaggccatgggtttgatcctggagggggccggacagccacctccagggatagcaggaactttaaatatcctttgtttctgcagcagatgcaaagatggatcagagaagcatttctctgggtgaatcagataactaggattgttaaaaaaaatcacaggagattgactgatttttggctaaaacttgaactatgattttggaggccagggtatatatattttgtaggccagtggctctcaaactcgaatgtgcaccagcatcagcttgacagtgtaggtcctcacctgcagggtctcttccagcagagtctgtgtgggcgtgagagcctgtgttctaacccattcccaggagacagatgctgtggtcctgggactgatctttgccaacatccactttacttgtcctggacatctcctaccccaggttaggacacatctccagaatgaagtgttgcctgtttctatgagaaaagagttgtatgtttatttttttgttggcttttcaaacggagaggagcagcttccaggagagtgaagtaaccaaccaatgattaataaaccctcagaatctaataaggagatagaagaaaaccaaatacagaaagcctcaaggacatgtgcagtataaattgatgaaagacagcagaaggtggcccgtccccagtctccatcccacaattgtggatcagtggcctccctgcagcactgaccatcagtgggagacctcctgcttccagtgtgcccatggaggtggggtgcacaggttaagcaagtgaaatctatgttactatgttggtttgtgtcttcgctagggtgctgtcctgtgatgggtgtttggcaccattctggtgtgaatgctgaatagctgagacaggtctcgtaaccatgcagtgggttcaccttgccccctgcccagacagagccaatttatcaacagggacattgctatgaagaaagagtgattcatgcagagccggtcgtgtgggagactggagttttattattactcaaatcagtctcccagagcatttggggatcagggtttttaatggtaatttggtgggtgggggcttgggaagtgggtagtgctgactggtcaggttgaagatgaaatcacagggggtcaaagtgagtttttcttgctgtcttctgtttctgggtgcaatggcaaaactggtcgggccagattaaaagtcttggtggtatcagctgatccatggagtgcagggtctgcaacatatcacaaccaccgatcttagatcttaggttttacaatagtaatgtgatccccagaagcaatttgggaaggttcatactcttggagccagaggctgcgtgtctcctaaaccgtaagtcctaaacttgtagctaatttgttagtcctgcaaagcagactggacaccaggtaagatgggggtcttcttgggctgttatcaattgatcaattgataagggctctatcagttgataagggctgtaaacaattttgtttcagagtcaaactgtgaactgaattccttcgcaaatttagttcagcctatgcccaggaatgaacaaggacaacttaaaggttagaagcaacatagagttggttaggtctgatttctgtcactgacataatttcctcagttataattctgcaaaggcagtttcagtctcagttaatttagaatgtttatttttaacaaagttgaggctgcgcgcccctgacagtctcaggaggtccggccgacgtgtacccagtgcggccggggcgcagcttggttttattcattttagggagacatgggacatcaagcaacagatgaaagatgtgcattggtttcgtccagaaaggtgggacaactggagcagggaggggacctgcaggtcacaagtaggtgagagacaaacagttgcgctctttagagtttctaattagcttttccaaagaagccagtcagattcgcatttatctcagtgagcagaggggtgacttcgaatagaatgggaggcaggttggccctaagcagttcccagctcgacctttccctttagtttagtaattttggggccccaagagttatcttccttttgagacaagaagtcttctcctgatcaaaggtttttttctcgatggaagtgttcctggtctcaccggcttcaaggaatgaagccgtggactgcagcggcgagtgttacagctgaattagagaaacgtgcggaccccaagagtgtgcggcggcaagatttatgaaagtgaaaggaaagcaaaagcgacagtaaaacttccaagaggtggaaggggacccggaagagttgctgtttctggcttgggtgtcttatgcttatatctccttataacccctccgcttttcctttttctgtcctatagagttagtttattttgtatctgcttgtgggttggtgggcctgattggttaaaaacatcaggctgcaactagagcttaaacttcctatatgattggttgaagtttcagtcccttagtttgcagctgtgactcattctggcttagggaaaagcccccttagggaagtccctattgacctaggaagtccagccagattagccacttagtccctcactttcacactgggccttgccagtgaggtctggctgtgcgtgctggtgccaggcacaggaaaccccagatggtccccactaccgggcgcaggtggccacaaagcttctgtaagttctcagggctttgatacttgaagacacactcaaggggcagttggtgatttcaccccgtggagagaagtccacagtggccatctgcagcttcgtgggtttcctcccttctacactaaagggaaaaaaattaaatacaaatcccctgtctcctttttgatatggagaagaaaacatttcatatccgtaaagaaaagtttctcatttagaatcagcttgatagaggatcctgtggaattataactgtttaaattgatgttattaatttgccagtcagtgcttactgttaatgacctcaggcctcacactcccctgcccaggagccctgaagcttcctcctggtcgtactgcccacccccacttcctcccctgcgcctccgcagactgttttaggacaacattcatcacttgacttcttgcagaaaatagtttttctttctcttttttttcttcgttgttctgtgcgtagaagtctgtgtgttgggaatgtcgttccggaatgcaatgtagaaaaaaaaaagttagataatccattaatattttaattattctttgtttcctgtacatcagaaacttttttccagcttttttgagttgtaattgacaaataagaaacttctttgtaagagattgtgaaatctgatttcaggaatcacatacaaccctggaatgtgtatctcgttgaaagttccgtgttctcattctctataggtcctcacttgaacttagttctctattatattttattttgggttcttctgacttcatcatcagtaaattatcacagcataaacacattgaattctaatgatctacaatgtgacttcttccaaatgtgataaaaccatagaagttatcatcaggttttcccactttaagagtgttaccagttcccatttccaatgttatcatcaaaggaaaaatgactttttttcaaaagtgataaaaaccatagaaattaacgttgaatttcctcactttaaatgtgttacaagttcacattttcaatgttaatcatcaaagaaaacacagtcccgaatcttctaaaagcaattcaactgcactgatttacccacaataatgatatttaaacattaaaggccaaatatatttaagaaacagtaaagcaaatgaaatatgtggcacacccagataagaattaataaaggacgttatgggatgggtgaggctcccactgagcctactaattggcatgcatctgctccagatagtgacctggaaaatgtttgttgacctaatatattctaaaagctacaaagcctgtatcatttactacatgtttctgtcattaactgtgaacttggctctaaggaattcctaacccttccatcatgtagccgagttataaaaaacatctcagcatggactgcctaaatattcttcatcttcctattttgtgtactgatggatcatttttctgttttccaatctcactggcattatgaaagcatcaaagcttttaataattaaacacagaaaaattccagtctctgattgtaatttgtcaaagctggaagctcagtggcacgtctttgccaattatcaccgtaggtctagccacagtgctgctttgcagtagcctagaatttaacgtggatttgtgtccttaaagggtctcgtagctattagtttcttcaggagttgcctttctttatgtggaccaagtttctgttctctgtgaactctgttacagagggagggggagattaaatcatttgtttttttgatggaagacagtgacttccattgataagagccagaaatcttcccctttcacagaaagtgttacttctaggaaaaaatcctgggttacagcatttagccatgcccagctgcagcccctgagggtctgcccttcctggcctcacatggtttggtttggcgattggaggcttatcacctccatctctgcagaagagccctaattttgtagggcatgcgatgtcctccaaacattgggaaagcacggggtgactggcaggtatttaaaatgcggctggtactttctggttctcttttagacagtttacttaatctacgtgtctcttagtttcttcatttccaccctggatctattgctaactgcgtcagaggtttgttgttcatatttaatgggatcatgttggtgtacagcctggcaaattgttggcactgagtatatagtaaatcctatttcttcttgggttaaatatcccttaatatttggtcatcaaagctgtcttatgaccagcaaatctataaataaccaggtcttaagaaatgtacgaagtcaaaccaactgcacttccctcacaaaagtcagcaaatagactatcattaacacggtgttggagtcactgtcattcttatcaagtctgtcaggaaaataacttagcgacattatgtagtaagtatctctgatatcctatacgatacaatattatatttctatgatattgatatatattttataaatttattttaaaaggaacatgtagttatacaataaagtttatagatttaaaattattcttaatgattaaaaatattttagtaaatctatacataagcattattaaaatttaaattcactaatcatttaatataaaatcagggagtgtgatgtgtgattcatgagttggtatctgagagtcattctaatagtttaaatttcttggagtattgaaaaaagaatgctttttttgtcccccccaaagccttggaactaagttacaattagaaaataagtgatgtactgtaatattacctttgtaattttgtgcaaattaatgctgttttatccttgctgccataattctagaatgaagtatgtcagaatgatgaaaaccctcttcaactttgaaattagaaaatcttggcttagtttcctaagaattcccacttcttttttttttttttaaactaggtgtttatgcacatgatttacttctcttttgaaaaaaaaataaaagattgattacattttagacaattgcttcacttctattaacaaatctgtcagggttacaattaatattattatagtgagaaataggaaagtaactagaagcaagtatagcaaagaagcccttgaccggtgtggtgggcgtgtgaattctgtaatgaaaaatacattgacactcatgcctgtaatcccagccctttgggaggccaaggtgggtggatcatctgaggtcaggagtttgagaccagcctggccaacatggtggaacggtgtctctactaaaaatacaaaaacgagctgggtgtggtgtcaggtgcctgtaatcccagatagctgggaggctgaggcaggagaattgcttgaacccgagaggcagaggttgctgtgagctaagatcgtgccattgcactccagcctggacaacagagtgagactctgcccaaaaataaataataaataaaaataaaaataaataaaaaataaaataaaaataccttgacaaacagacccagtcagaaaagaaactcctttgttcctggactactaaactagtatgtttaataaaccaagccatcaaaaggttcatgtttcatgtatagtttgtccatgaccatgtaagaaaagtattcttattatacacattttcaggcacataggaacagaattcctaaataaattccatggtgtataaacaataaaacagaaaaaatttgtttctgtaattttaaaagacttctccctcctttgttttgtgatttctggcatgtcatgagcttctgtcttttgtttggaaagtgacatgttttaactaggtgtcctctaagacacattctgagcctgacattctctgcatgagcctggagtgtttctgaatatgtatttggcatctaaacttacttctttaaaagtcacgtgatgaagttactgactagagaaggccagtggcaggtacacagactgtctatttggcacccaaaagtgtgaggccacaggccatttgaaagcctcccggtcgccagttttggtatcccttatcgccagaagatgccaaatatagaaatttggaaataattgatctcctggttcttcttctagcatttgtgtgagaagtgactggcagggatgagacagagaggaggaggaaggagagaaaactcaacaaacaattggatgggcatacggtcagcatgttggcattagtctaagtaagaatctgattttataaaataatcttatcttatagctaagtaatcaataaaattgaaataacactgaagtatatataataaaaggtgaaaacccttctttaccccaaatcctttttatgccccaggagtcatggctgtcagccaattaattttttttattttaaattttgtggatacacaataggtgtatatatttatggggtacgtgagatgttttgatacaggcatgcgatgtgtagtattcacatcatggataatggggtgtccatcccctcaagcatttatcctttgtattacaaataatccaattatactctgttatttttaaatgtgcaattaaattatcatcaactgccgtcaccctattgtgctatcaaatactaggtcttattcattcttttaaactaatttttttgatacctattaaccatccccagctcctctcaccctcccactacccttaccagactccggcaactgtcctgtactttgtcgaaccctttcagatgtgtctccagaaacatacacaaacgtgtaggagttttaaaatcataaattgcatcgtagaacgttttgttactcagctcaggctgctgtagcaaaatgccatggatgttcatttcccactgtttggaggctggaagtttgtgatcagactgccagcccactgtggttctgggaggactctcttcctggcttgcaagtgtgtgcttgtgtgcttccttgttcctcacagagcacagacagagcagaagtcctggtctcctccctagatagaagaacactactattatcctctggtctacacccttaaggcctcatctaaacttggttatttcccaagcaccccacctacaaataccaggacattgaggattacgagtttaaccaatgggttttcgggctgacacagatattcagtccatgacacatcaatatcatcctgtgacttgatttctaactgaaaacagtaaaatcagtagtagatcaacctctttaaaaaatgttcacttagcattccctgctgtggatgtaccaaactttgattagtaatttgcctgttgacatttagatttgggttgtttccatttgtttctattttttttttaattttactttaagttctaggacacatgtgcagaatgtgcaggcttgttacataggtatatgtgtgccacgatggtttgctgcacctatcaaaccatcatctaggttttaagcccgacatgcattaggtacgttccctaatgatctcccttctcttgtccccacccactgacaggtccctgtgtgtgatgttcccctccctgtgtccgtgtgttctcattattcaactcccacttatgagtgagaacatgtggtgtttggtttgccgttcttgtgttagtttgctgagaatgatggcttccagcttcacccatgtccccccaaaggaaatgaactcatcctttttaatggctgcatagtattccatggtgtatatgtgccacatttctttatccagtctaacattgttgagcatttgggttggttccaagtctttgctattgtgaatagtgctgtaataaacatacatgtgcatgtgtctttatagtagaacgattcatattcctttgggcatatacccagtaatgggattgctgggtcaaatggtatttctagttctagatccttgagcaatcaccacactgtcttccacaatggttgaactaatttacacacccatcaacagtgtaaaatgtgttcctaagtctccacagccttgccagcatctattgtttccttactttttcatgatcgccatttttactggcgtgagatggtatcccattttggtttggtttgcatttctctagtgaccagtgatgatgagcttttttctatatgtttgctggctgcataaatgtcttcttttgagaagtgactgtccatatcctttgtatactttttgattttttttttttgtaaatttctttaagttctttgtagattctggatgttagacatttgtcagatgggtagattgcaaagcttctatttttaagtttgctgcagtaaacatccatacaggtcgaacttcttcacatgtgagcatttcttaagggcatgtttcagaagtttagttgctggaacaaagcatgtgctaaaaatttagtttttaatattaatagctatttgccagcataaatgtaccaacacacccctctgctcccactgagagtctgccaagggccgtttcctcactattctgtacacctgcaaacacacaagccttataatttgtctaatcatatggccgatgttacacccttcattgttccctgatgactaagaggcttgagaaaaacttttttttacctatgtcatttctcatgtgcctgctcttgtcctttgtacactgctttttttttttttcctattgacttgccctgacttttccaggaaaatttctttctctagttttaaatgtctttcctctactttgttttgtggtttttgacatgccctgagtctctgtcttttgtttggaaagtgagatgttctaactaggtgtcctctaggatacgttctgagcctgacattctctgaatgggcctggtgtgtttctgaatatctatttgacatctaaacttacttctctaaaagctatgtgatgaagttactgactagagaaggccagtgtcaggtatacagtctgtctatttggcacccagaagtgcgggcgcttcagcgttttaacacaccttttctctaactggaagtcctttgtaaaaaataatcattgccatcatttattgtagctgctattagctgtcacaatcagtgagtattataataggctgccgagagagttggtcggagggagatgatttatagcacattgagtgcatcatttattaagacgatcataaccctgaaattgcagcatgcggtcctgcttgtatttaccttgcggcaggcagaggttcagcttgggagctcctttgcctggtgtcccggtgttatgaagcatgaggcgatgacagtgttggtacaggcagacggtgatgtataaggaggatcccaccagccagccacgcatgctgcttcgagtgagttccttgggattatagatgagaggaaagcagacagaaacgaccatgagatggagggggtccttggaagccattccagcaaccatcgagatgaataatactcagataattcgaggacgtgtctgtcttttctccttggctagaatgtggcagcaagaaaaaacaaagctcaagggggaaaagggagtagaaaggaggccagatttcattctggttaactactgacagtttccaaactgcgaaaagaaaaaaaaaggttaagcgtcaggccatcttactgaagatagtcactaggtgtagcctcttaccagcctgattctcagacttcatggaaaagacaaaggatggtacacatttcgagtacctcactttctgatttcagaaagcttattctttttctggcacattgtacagtaaatgccaggtgctttttgtttttttttaatagaccctattttttagagtagttttaggttgacagcaaaaccgaacagactatagagtttcccgcaccccctgcctctccacgtagccgccccttttagcaacacctgccctgctgcatggcgcgtttgttccatccaggcacctgcactcgtacatcgccgtcggatgtgtacagcttacgttagggttcattcatggcgcgtttgttccatccaggcacctgcactcatacatcactgtcggatgtgtacagcttacgttagggttcattcatggcgcgtttgttccatccaggtacctgcactcatacatcgccgtcggatgtgtacagcttacgttagggttcattcatggcgcgtttgttccattcaggcacctgcactcatacgtcgccatctgatgtgtacagcttacgttagggttcattcatggtgtggtatattccatgggtttggacaagtgtataatgacatgtatccacccttatagtatcatacagagtggtttcaccgtcctaaagattctattttatgttgggtgcggtggctcacacttgtaatcccagcactgtgggaggctgaggcttgtggatcacctgaggtcaggagttcaggaccagcctggccaacatggggaaaccccgtctgtactaaaaatacaaaaattagctgggtgcggtggtacgcgcctgtaaatcccagctacttgggaggtaggaaaatcgcttgaacccaggaggcggaggttgcagtgagccaagattgccactacaatctagcctgggagacagagtgagactccctctccataaataaataaataaataaataaataaataaataaataaataaataaataaaataatgaaaaccctgttttcttggtgtttacttctccctgcccccagtcactggcaaccactgatctttcttctgtcttcctgttttcccagaatgtcatatgattggggatcatgcagtatgtaccttttcagattggctttttttttactgagaaatatgatttacattccaccatgacttttcatggcttgatagcttatttctttttagcactgaatattgacagtccattgtcaggatgtcccacagtttattcactcacctcttacagggcaccttggtcgcttccaaattttagcaattatgggcaaagcacatataaacattcaggtaagtgtggagtttgatcacgtatatatttatttaaaaatgtatgatcagttaagttccttattagccaaataataaattatgaattagctgacaaaagtgaaagaatcctacgttttttcaagataatttttagttgtaaaaaaatacgtctaaagcattatatataaaaacacaggcatacctcagagattcagttttagactataaaatgaatcataggaatatgttggcttagtgcatatgaaaattatgtgtacacagtagtgtaacctttatgcaacagtattatgtctaaaatgtgtacataccttaattttaaaatattttgttgccaaaaatgctaaaaattatctaagcgttcagtgagtcataatctttttgctactggaagctcttgcctcaatgttggtggctgctgacttaccaagatggtagttgctgaaggctggggtagctgtgaaaatttcttaaaatgagatattgatattttgcctcatctatggactttttttcatgaaagatttatctctaggtttcaattccgtttgacagcattttgctcggagtagcaattctttcaaaatttgaatcaattctttcaaaccatgcttctgcattatcaactaggtttctataataatctagatattttgttgtcatttcaacaatgtttatggcatctttaccaggagtagattgtatctcagcatactattttcctatcttatctggaagaagcaattcctcatctgttaagttttatcatgagattgcagcaattcagtcacgtcttcagcctccccttctaattttacctctcgctatttctaccacatctgcaggtacctctgctgaagtcttattatattcttgaaactcaactgtaaagtgttggaatcaacttcttctaaactcctattcattttgaaattttgacctcctcccatgaagcacaatttttcttaatggcatctagcaaagataatcctttccagaaggtttttcaatttattttgaccaagtccatcgaagaatccctacctatgaaagctatagacttatgcatttattaagttataagagttgaaagtttgagttattccttgatccatgggctgcagaatggatattttattagctggcatgaagacaacattaatctctttaagcatctctgtccaagctcttccgtaaccacctgtgttgtcaatgagcagtaatattttgaaaggaatctttttttcctagcagtaggtctcaacagtaggcttaaaatactgcattaaccgtgctgtaaacagatgtggtctcatccagactttatttttccacttagacagcacaggcagagtgcatttagcatcattcttaagagccctaggattttcaaaatgttaaacaaacattggtttccactaaaagttaccagctgcatgagctcctaatagaggagtcaggctgtcctttgaagtttttaagccaagcattgacttaccctctttcctcctatgaaagtcctagatggcatcttcttcctacataaggctgttttgtctacatggaaaatctgttgtttattgtagccgtcttcatcaatgatcttagatgttctggagaacgtgctgcagcttctacattgacatttgctgcttcacctggaacttttatattatggagatggcttcttttcttaaatcttatgaaccagtctctgctggcttcggagttttcttctgcaacttccttacctctctcagccttcatagagttgaagaaaatgaggagcttgctctgaagtaggccttggtttaagggaatgttgtagctggtttggtgttttatgcagataacttgaaaactttctccatctcaccaataaggctgtttcattttcttctcattcatgcacttataagagtagcactggctgggcgcggtggctcatgcctgtaatcctagcactttgggaggtggaggcgggtggatcaggaggtcaggagttcaagaccatcctggctaacacagtgaaactctgtctctactaaaataacagaaaattagccaggtgtgctggcacgtgcctgtaatcccagctactcaggaggcagaggcaggagaattgcttgaacctgggaggcagaggttgcagtgagccaagattgcaccattgcagtccagcctgcgtgacagagcgagatactgtctcatttaaaaaaaaaaaaaaaaaaaaaaaaaaaagcccttttattttccttgaagaacattttatttgcactcacagcttggctgttgggtgcagcaggcctagtttttttgacatgtctttctcacttagttaatcatttctagcttttgatttaaaatgagagatgtgcagtcctttctttcaattgaacacataggagccactgtaggatttttaactgtccgaatttcaatattgttgtgtctctggggctaggaaggcccgaggagggagagtaagataaagaacagctgatgagtggaacagtaagaacacacaccacattaatcatttaagttcactgtcttacatgggggtgtttgtggcatccccaaaacaccttaaatggtaccatcaaggatcattgaccactgattaccataacagatataataacaacaacttttgaaatattgaaagaattaccaaaatgtaacgcaaaaggatgaagtgagcacttactgttggagaaatggctccaatagacttgcttgatgccacgttggtacaagccttcaatttttaaaaacgcaatatcagcaaagtgcaatacagtgaagagccataaacaaaagttatgtctgtgtgtataaaattctaacgtttggagccataagctggagcatttaaggatatattgtttaatatttttaaacatgtaattaaatctccatatcacttgcaaaccctcatatataaatataggggcttgtctggggtttgtgggatttggggcaggatcccctttggacaggtccctgcttgctgagaaccagccctcatacacgcacagactgtgaagtcagcctccccagaagagggaacagagaaagcaggacgtgctgtgtccagtttgggatgtcttttccaaacttcctgtattcaggatgggtcactccattggcaggagggtggaagaaccaggggagaatggggagggaacacatcctcttttacttattaaatatttactggcaagctcagccttgtcagggcattttcttcctggatgggttctctgcgatggagccctagcctcatcacaggcctgtgtccgttgccagggtggagtctgtgtaaatgtgcgggagcaggcacagaaaggtgtatcagagacattcattgatgccttctaagaacctcaggaggtgagcttcacacccctgaaagaggtgttactggttcttgataattatggctcagcagctatagactgcccagctcttttaagctctggatgcccagcactttgaaggggcccctgatcttgtgggctaatgtggttccttcagtttccttttatttcaagactagcctcagacaaaattgcaaatgttaacataaagtagatttttatacatttcatgtcatttaaaagacttggtataaacaaaataatacaataaaaaactatgtatgtaaaattacagagactgtgcttttgccatactttatttattttaagttctggggtacatgtgctggatgtgcaggtttcttacataggtaaacatgtgccatgttggtttgcggcacctatcaacccatcacctaggattcaagccccatatgtattagctatttatcctgatgctctccctcaccctatgccccacaacagttcccagtgtgtgttgttgccctctctgtttccatgtgttcctactgttcagctcccacttataagtgagaacatgtggtgtttgtcttttgcttcctgcaggaatttgctgaagataatggcttctaactccatccacgtccctacaaaggacataatttcatttctttttatgtttgcatagtattccatggtgtatgtgaactgcattttctttatccagtctatcagtgatgggcgtttgggtggattccatgtctttgctattgtggatagtgctgcaatgaacatactcgtgcatgtgcttttcccattactgggtatatatcctaaggaatataaataattctataataaagatacatacttttttaatactgtttatttccatgtgtatttcatcaataaacttttcccaaggtcttttttcgtaacagcagattctttcttcagccatcagattcttctgctcataagatttcactgatctatatctaaaacaaactgactgatgataatagaaagcaaagacgtggaaccaaaagatgatgacaaacataacacaaatatcaacaaaaatattgggaacagggaaacttttctgtccgaaatcattagagtgtacgaaccaaaccagagcaaaacaaaactttgtagaaggaatccttgaaagatactagatttctaccagatttttccatgcggtgcaaggtttattaagttatttcctttcgcagggagtccctgattgcaggcatctcttagtgagcttgttccagctcagattgcattttagaaagaaactgtaatacttattaattgatcagctgagtacttctagaatgtcattgtctcactttatgtcttttgacataagaaaataatatttcagtactcttcaaggaaaaaagtctctgatttccttaaaaaaagtagaaatagaagcagaacatttaaaaacatacatattcttgaaaatatctctcgtttgaatgtctgtaatctgagttcatgaacctctggatggttgagagcatgagaaaggggaaaaaaaaccctgaaattataagcagcaaaacattttcttaggtaactttatagaaacacacacatgcacacacacacctgtatatatcaggtatatattagggagaaagtacaaaatggttttcagaaatctgtttaaaaattaaactagtcagaaaattgtttaaaaattaaatacaaatgaaaatccttaacttgcacacgctaggggaaaataatatatgaaaagttaacatttcttggagtatttatgagagggatctggcttaaaggaaaagtaatgaaaatgtagatttccagagtactatatttttgactctttctgctggctgacttttcccttagattaaaaacatacatatccataggctgaagttagaggccaaaaattcacaagttcctgggaaatggtggataaataaattaaaattgcttctcacagtatatcatgacttgtttcgttgccaagctttcagtcttgttttattttatttcatatctatattctctagattttaaattttattctttagatatgtgatccagatgaaatggcagatttgcatatttaaaccttattattctaagacacttttccaactccaccgttatttccatgctggaggaaagcttattattccacgtgatcattgggtgacttcaagtttcagtctagcctgggcacagtttatcttaatcattttagttaacacaggatgattctgtggttctagttagtccttggactttttcatagagtattattcaccaaattgtcatgatcttatttcattttctgtgcccaaattgcctggaaaagaactttattatgagaaaaagcacaatgactgtcttggacctctcccttatttttatcttactctgttttaagtatttatggtaacaccctttttgtttagtctctcagtcaatgaccacagaaatcaaactgtcttatgttacatgacactttaaaaataagacatagttgttttaagatttttcatagcatcatatgcctcggagtatcttgaaaattatttaatgataatggacaacaaacttacaaggttgccaatgatgttgtctagagcttttgattccaacaatatccaaaggcaaatgctcctgcgtagttccagacattgactgggaaatgatggtcaattttgcctgaaaacttcagtgactactgacaataagtctacttattcatgcacagcatgtatgggattgtaaagtagggttacatatttagtggtgtggtactcaattcccaaatagatgaaactttcaccgtgattaagattctttatttttgctaggtcactatattatatgcccagtaaatctatgaaataagattttattcgtgaaaatgatagctcagctttgaggaatatagaaaaaaaatacagctgctccttcatatctgtgtgttctgcaaacaaccaagggtcaaaaacattcagaaaaaaaatggatggttgtgtctataccgaaaatattcaggatttttttctggctattattccatgaataatacagcataacactatttacatagcatttacattgtattaggtattataaataatctagagatgatttaatgtatatagggagaatggatgcggttatatgcaaatactatgccattttatatgacggacttgagcatctgtagatatttgtatccatggaggtcctgaaaccaatcctttccagataattcggaaaaactgtagtttctaaattatacataaatggacaatttctaaggcgatggaattttttgtcacagttttttaaatgatttctggctgtttccactaaagtgacaaattcttgcagataggctgatgttgtgcatgcatatgcagaactctgctggtctttgccatgctacttaggagcttgtgctttagaatcaagatatttcagatcttaatgagctgcctagaaactaaatgtaacaaaagtcggtatgcatacacttcgtttattttaagtattgtctgcttaactgttctaaaagggggaaaataatttgtcgaaagtgtcaggtggcatttcaaaaggctcttctgagactctcgggccgggaacctgtgctgttgccgtgtggaaatctaaagggatggcatatcagtggatggtgatttctgggaaaacagttggggttacaaataaattatcaaattaaaactgcatttataagagcaatcacttgccactaaatctgatgcttttaaagcagagcccttcatgagcaaatgatgaacaacatggcagtcactttgtcgtatgctatgaacatggtcgagagtagttcttgatacagatacccggggtgagatcttgcatgccaggagaatcatcatacaacacccaatttttacaattgtcatatgagtttactggcttcccagagatcattcaacagcatttgaaacaactcaacctatagaaattaaatattaaatgtttacgaaggacttcacataagcttgatttgtttcccatagagtctgatacaacttaataaaaataaaactgtctctcttctgtcttctccccttccctaccctcctcctcctcctcctccgtctttttcttgttctctctctgtctctctctctgtctctgtctctgtctctgtctctgtctctctttctctctctctctctcccctgcagtctttctgtctttcccttactttctacttctctaagctccccggtcaatgctacttttactgcagttttcagtccgtagggggcaaaactttgacgaaaatgttatttgtttcagtttgtatttaggaagatgaaagagtgagtaattccttctatttccatcagagagaatgtgcagcctgtctcttcgttcttataaagcaggctcagattgcctgtcagttattaacagcaggtggtgacagcctcgtgcagtcatgtgacaaaccgcagcgtccctccctttaatcacagcatctgatggagcgtgtgcgctgcccggttccctgtcatgttggacacagatgatggattgtacttcaaatgagctttcggtggtgctcattgtacatgcagtttgagtcgctcatactcccagctattcacaaagcgcttgcttataattagaagccagcaggtgctactttgtagcttaaaaattagcccagatatcaattagtgctgtagacatggaattcttcggtgtttgaaatatccgtttcacttgtaatcattatccagtgctttaaacaaatccgtaccaatgtgatgtgtatcaagacattttctgctgtggagcgagtgatttttgtatagagaggactttatcctctacaggtggctttgtaaggagctttattcctgaatggaaatcctctctatttcaggaagttctaaatgaggcagtgcagcgtgttgaaatggcaagcactttgaatcagctggaactgggtttccattctggcgccagctacttctagctctgtagtagtgcaagtgtttttcagcctttttgttgcatttgttttctgaagttgactggaattgtgtgtagtagaaccagtactatgcttggttgttagtcctcatttctgtcgtcattatcaccttgttcatgttgtcgttgacatggatgcctgcttggagatgtgccgcgtgatatgtggcagctctcatacaattttctctcctgttagtgttgtctaaggcccatctgctgagtctctgacgtagagcttctccctgtgaaactgagaaccacaacgcgttttggtttataaataagcctattgatttgtttttaaatattaacgatgacttgagttgaagaaatgcggggcagtttttcttttctctctgacttcggatagtgtgtgctggtgtagacctgagctctcccagaccatcgccgtcagccactgtggccgctgatcactagctgtgcggggtctgttgttgaacttaagagctgtgtgtataaaacgcacatcagatcttaaagacttggtatgaaataaagaaaatgttttactgtttttatagtgaatacctatcaacatcacattttggatatattttggtgaataaaatatattcgtaaaattaattcacctttaattattaactcacatttttagttttttaatgtggcttctcttaaatttaaaatatcataggaggctctcattctgtttctattgaacagggttactcaagagcaatgcagagagaatgaaagctgagagtttggtgtgtaaaattctatagagtttgatatggaaatgacttgtataatatttaccagatcaattatgcagcattgtaattgaatgctttattttgacttaaaaaatataggtattgtggatacttccttttagaatttgaggtaagctctaacgtattttcccacccacagaaacacatacattaatacttgtgtttatcctgctcggaagtttatagatcactccctgacccaatgctggattcctctcatagatctccgggtgtccatcaggcacagacgctggtctgtactcaccagagaaacatgtaataaatcgatggtcactttccctccacccacaagggttgtcctgcctcagagactctacatagctctttctcctgcctggcacccctaaaatctggcctaccttgatgcagtggagatggtggcacacccgaagatgcaatctcctgctctacattttcctgtggtgaagttgggacttgtggctaattcaggtcaggtattcaggacgcaccgaaccttgggctgaagcctgcaggggccagcacagagccgagctgtgtcctgtctgctctgttgtcccgggaagctcagagggtcatggcctcagcaaaaggggtgacaagtaactcagtggaaaggacacttttcaacgctgtagaggagcctcttcagtgagaaataagcttatgtttactacgatccagaaagctgtgggttgatcttgccatggggtaccccagcctaggctaatatgacaggtaaacctgctaatggggtcagaaaccacgttccacctgctactccaatcccctttgctttccctgtttcctcttctgctgtagccctcatcacctactcatagacaatgaatttgcttatttgtcgtattttttaattgtctgcatccagcagaaaataagcttaatgaagcctagaaccatctctggaacatagtttcctcagtatataattatttactgaatgaatacatcattaatgagtttaaccagtgtccatgctctttcctaaaaatacttttctataaacaccttcttattcatagttacatgtctaaagcacatataaacataaaaaaaaaattcagaagtgttacaagattaagatcactaaagcaatgaaatgaagttaaaatgaaaattccaccttacagttgaatacggccgttgatcaatatttagggtttcctttgacgttatgtgagctttttctgcccttggaataatcttaggatgtatggcatccatggaatggatatctaattttcagttgtacgttattagtgattgtgtattacatgtagggagctaaggacacattaaaaccctcccttgctgtctttactttaaatttcattgctgcctttagttggaattaggcccttagcatttctataatgtagtttttaattgaattgctttttttttaatgtgaaactgttctattatgatcgaattggcagtggctgtgagcaagcatgtttaaactactgttgtgtaattctcactcacagtgggattgatcttaatggatacaaaagaaaaagtaatacctaaaaatgtaaggctaagcactcagaggctttgatctcaaggaaacatttaaagacactcttcgtaaaggtcagcaaatagccagcagttcctgggaaacggaaagccggattgtgcttttccccgggctctgacctagttcctcttgggactgttgccagctattgtgtgaaaccgcctggaactgtgctgttttactagtctgtggcacagctctttcccatgtatgacaaactagcctcattccagacactctaattcagaccgttctcatgcaattattaattcatttatttacagtttaacagaaaagtggctttgaaaagttgcaaatttagggtgtgggagggtggggcctcaatccgtgaaagcaagaaaattcaatagagtcaaatacattcagtgcacatatcctgtgtgtgtgtgtgcatgcgtgtgcgcatgtgtgtgtgcgtgtgcatgtgtgtacacgtgtgtgtgtagtactgccctgtgcattttttcacagtgtgcagtcttaatgccttttgtgttctaagcactcatgtggagaacaccaatccttgcacatgggtgcttagaactcaaaagaaaagatggagtgagataaatcattatgtatctatgtctctatgtgtatccgcactcacgtacattcacacacactatgaccctagagaatgaactaaattccagtgaaaatcaaggacagtaactgctgcagacgagggactgaatcaacactctgcttctgtgggacaggtcaatcttgatcatttgtgtgtcttgagggagaacctattgtagtacttgagtaatgcccagaagggccaggctggggcagggacaggcctgtgcaggtgtgcagctggggcactcttagaacatcaggagctcacgcgtctgcagcacagggtttgaggagtgaatgttgcaacacaggcacaaagctgtttggccttgggaacctggagagaacaaatattaactgcaagagatatagcaccagacaatgctgccagggagttagagcattttatgaagaggctgtcatggaatttaccctttctgtcattctgttttgaagcaggtaacttttgtaatataagaagtttcagcttttcctactatcaagtcttggataaaggaactcttatcatgggttttaagcattcactccagtttataatcatgtaaaaatgtggcatatcagatacctaatgagatttaaagatccttaagactacacaagtgtttacatgaaaatatctgaatgagtccaacattttttgtatccatcgtatcaaactttgatgcagtcagttttacatgtgtgtatatatatttacatttatatatatttatatgtttatttatatatatgtaaaaccctttttaaaataatcatgtggatgttatggtacccttttttaacagacaaaaaagccaaggtttagaaaagatagagaatttggccaatggttccctgaaaatcattggagatctggaattcaaaaccaacttttttctactctggagaatattgatgatcactgtgtgtatatgcacacacacgtcatactttcagtatgatatatataatgtatgtatacactgatcatcagtatagatttatatgtatataattatatatatttacctttttgttagaaaatgttgctgttactggttttgtgctgactggctcacagttgtggctactttgcaaaataactgttaactcgtgttcagagatagaatccactttatagaactgtctggagctcaaaaccaagggcacaaccatgtaacataattctctgacccgctgagtcaactcacaatgtcaaagagtaaaaagtttagaatacaaatatttttatttgctggctctgcacgtgttaaagttatcagggaatttgtcacttatttttaaagtaaatgtgtgactccagcactcagcactttgctataacctttagactgcagaggtaagggcgctggttctcaggatagattccttcctgatatcaagcaggatatgaatgcgggctgcacacaactgctgaaggagaaaaatcatcttccttttgttgtcctggactaattaaattcaaaaatatctgcttccaatatcttgtctaaaatcttttggatacattttaggagaacattatcagtaaatgtcctgaatattggagtatttaaagttttacagcaaaaaacatttaaaaggccaagaacaggaggcatttgagtagacatgagttacattagattgaattatttcagcctgggagtcagcctcctgtgataagctgacatttcagtgaccataagcctccccattgtcgctaagttttcaaagaattctgcccctcaagtgacagatttgatatctgcctgaaactgaccaaggactttcttaaatctattatgacagaatcagggagaatattctccagaggggttaaccttacgaagttaccaatgtccagtttctcttgcaaggaaaaacaaagcaaaaattctacatatttgtttaaaattaatagaaaaagctaagatcatgatttctctgatcttccttataatgtgtaaagtatagcatatctaaaaacaaaacattacagaagggcaaggggcatgagtcctaaattacaaaagagacaataaagcatttaacacagaaaaacaaaaccagtaagtcatttacatgatttgaggttgtttttgtttttatatatttcttatttgtttcaatgagcattacttcagaaattagtgcagcgcaggtaaaacttgctgatctcagaagactgacttgggatttctgcatatctgtgacagtaatccctcagctattgccgggtccccagtccccaacaccatgggattcaagagtcctcctttctctattagaagctctaacagcaagtccactgggaaaatgctgtacattattaggagagatagtagttgttaacaagatgatgggcaattgcaatttgaattttcagattcaattcagagatgtgcggagtgagtaattctccgttcactttgaactcacagacttctgtacccagcatttgctgtcctaagcaaaagctttcacttatcattggcccagtttgcttttctcctctggaatgtggtttgattactcaatcatttggttaccatcactttcataaattcaacattctatttggaaagacttttaaaatgagccaaggtacttcagaaggtcctcctacatttgggttggaatattttaaaatgtacttctgtaaaattaagaaacttcctacacatccataattttttaggtatgtttcctggtcggcatatttggtgactgcagggtgactgaggacagctgcaccatggagaccttttgttttgacagtgtcagagcacaagggtaactgtgcagccaatgaaaatattcacctgcccaaccaacctgagtgggatcgttgtcagggccccagatggaatgtggtattggttagggctgcccatttgcactgtctttccttccacagctgttcaagtgaaactctttaacatgggagtttggaagaacaccaaagtgttgcaatgagttaacctcaggggagaaacagcaaaaaacaaaaggaaaaccaagaattcatacgtgtatgtaggcatatagatgtattcagatggactcatagacagtatagagtggttcttaagtgtcctgctgaggcccttaaaagactattcgctggttaaccggtagatgcatagttctgaacccagcgccgtctcgtctctggcatcatctgcctttgcatcattctgcaatcacaggctgcgtggattgggaatttctaggactacgcagttcagatttcagtattgtgctgatggagtgattacagacaatactctgggttcttagcatttccaccttcatatacaccactttctgttctttatttcttgtataaatggaggctttctaacatatatttttaagtctctgaggctcttgcttttacagtttatacatgtttaacttttaactttttattttttggcaccatactctaaaggtaagatcgatgacttcatttatgtagtcccctgcagctccctagaacagcagtgtggaagtttatgaggaaaaaaattaaagagtctcccagtatgaatggcaatttcagcaccctttttccatcatcgaaatgatggacatacttatccccattatcacggtggaaactgtatattttgagctcttaccacctcccaggtgatgctgttctctttatacattctttgatttgatccttcaacacttctataagatacccatttttaatccattttatagttgatgagactaaggcttagaaaagttaagcaacatttggagataaaaggatagtgaatttgattctgctttgaacgggctacagagtagttggctgactagacacagggaaggtggaaggagatgggtggtggaggaatgctgccagaatctagaagtcacgaggcattcatttggtgaaggtttcatttggtaaaagatactaataagatacaaaaaggatgaatactatgacaattaactgcatgcctactgttttccatctgtatgctagagactatataatctcatttaatcctcacccttccccaaggtagtggtagtatatgccccattttactcacataaaaaccaaggtattgggaaaagtaagtaatttccccggagtcagaaagccagtgagtaggagtctggattaacccaaatttcttggattctaaagtgcatgctcacgttattacattatatcttcttctggaagtcataaaaatgaaaataaatgaatgagagtttagacaactgtattaggaagtaaaataaatgagtatttttattcactattgttgttgttgttgattttttgttagaaaagtctccatgtctgaactggttcccagtacaactaaaacttaaataaacggaaaagaaggatgttctaagggagcaagatgtggatacaatcagggatttaaagtagccttcccagtactatcataagggaagtggctgggagattaactcaggaagaggttctagttttaaggaggggagaaagcaagtaaagtcccaaaagaaaagaagaggttttgtttgtttgtttgtatttaaataagcagactgcattggtttattctgaacccaagaaagtgaggttttttttttttaattgggggatggttttgaagaacagtttgattgattgatatatgccatgccttaaacagtacttcagtttgttcacaaaggtgctcataatggcacaatccgtagtgaacagcattgaaggctggaaggagcactgtggaagatgattgttggaggcttaggaatggtgtattagaactgagtggtggcattgcaaggctttagaaagcagcttcaggtaagcgataggaggtgaggcgtgattaccagattttatgactgaacagatgttgaaaatgggagaaagtgagtatagctccttcatgtaattcagtagagataataaggatagaggcgatgaaagtaacagaacaaagaaagacacttgaagagggaaggaattagaaatggtgtgtgtgtgtgtgtgcgtgtgtgtgtgagtgtgtatgtgtgtgtgttcagataaataagacatatgcatggttggggcctgaaagaaggaatccactggtagcagagatggacaaaaaaagaaaaaaacagatgaaaataatgtctagaatgaagaagaaaaaaacagatgtgtcacatgcatccacatttgttattaattcagctgaagagttgtttggagtctaagagagttcatgtgtattcttacctctttgaaaattgtaaaacagttttaacattttttctgtgttgtaccccagtctctaatactggttctaacccacagttggtcctcagtgctttctggacgggaataaatgaatgagtgagcaagatttatggcatagccttagtgatgagaagagacaactttttatgacattgtcttcttattagtaatgactgcaattctatccctgtctgacaaaggagagcagaagggataaatattgctgaatggaaataaacctagagtaggtgctacagagatgagaacctttatttgccgtaagacagtgaagaattaaaaaccaccaatacgtagaaatggggtatttcactaccttcacttatttgaaccttagagagggtgttgagttcccaatctttcaggccgaatccactgactgaatccactttctcagctctctgtggttgacttcgcagctgggtaactggcctaaaactaaaacacaggagctagacaacttccaacatggaacaatatgtgtctgatgcatgttgcacatattatgtaacatgaccctgaaaaaaatgacaaatccattttggaaaattaaattttgtagaaaaaaaatagtgaagatcaacactattatgatacgcatttattctcagtgtgatactttatgaagttcttgttccaaattacttgccttttgttctgatgccattacatctgaagtacattgtatttattgtaatataattagattctattcaaagtatgtgtatagaattgtgttgaaattagctttattctaaagctgcaaaacatgttattctaatttacaagggttttatatgaaatctgatgagtgaaagatcatcttaattcagcctttgttgttgagatattttattttaacaagaactttaagtgagcattctctgtgcctgaacaaaaattatatgaactcctgcaaatcactcttgacagagttcatttccatctgatccacagattctaaaaaataagaacataccatgatcaaacagaaattaactttaccttcatatgatgctctttttcttccaaatgttcagctgatgaagccccatggatagacgtagtcacacagtagtgtaatagaacgttgtctgaaacaatagacagggcaaacataacccacccacagcatttgtaatcatgctaaaactaatgttcgtacttacccagaatttgacaactacactgaatttgttttttaagtattaaccttatgttgaatgttctttctgaattccaagggctaaaattcactgtcttaaacaagaacatcttttaaagttttttacttgaatccctatgttgcagatagcttatctccaacataagctaatcaatctgggtgttactagaatcatactgcactgagtagtcctctgactttctgtcttgaggtgaatctgaacacaccaggggcaacaagacattcaaagggaatctaaatctttcttaattggcacaaattattacaaccccctttaatgaaagatgctttatttagcgtatatgtatacaacgttcatgtgtggtctgtttaattcttataacacccgtgtgtggtaagcattcttcttttacacattttataaaggtgtcaactgaggcaaattaaaataagtgtttcagtatcacccattttataagacagagcttagactgtaatctagttttctgatttccagttctttgtactacaaaagggacttatctccttccaagctacttgattcattcaatcagcaattgcttattgagcatatataatggtaagcatgacagaaagaaatgaacagctcgttgcagctcagagtgcagagaggggaaggcacagccgtgcttctttttgtagtacataattaaagagtaaacatttatgaatgaggcatcagttaattaaaaaaagatgggggtggaaaaataattttcaaagattttatctctgcccatccctttgaatttactcactggctcacacatctaaatggcgtttgtttttggggtgtttgctctgcaattatgtataaaactgaggcaactgagagctttaaaattgcaagatggctttgcaggaatcctttacctgagacacacacctccattaaatatatcaagaatgatgggtcagaagacagcgtcggagtgcaactccgcaagtgtcttctaaattgcagggaaaaaactcatacaatattctttttattttctcagatgattacctatggattagtgagtgacgcttttggaaagtctgaatttgttgccttatgttcttatctaaatatcttagtaaagatttttaagatatctttcattgtaattgatcagattacacaatacaaacttaagaaaaggtatccttagtggcgtgcattatcaatcgttaagaaaggatttaacattctcagttttttctaagtagtcattggctgtctcataatttgagcctatggggattgcctcaaagattcttacattttagatggggatcatctggtttgcatttttccttcctgttttcactctatgtctggattagagccataggcatccactaggccatgtctgggagccccatatggaaatccaagctgtcctatttctgggttgtttcctctgcagacaaatgtggtgatcctagcacaatggcatcccaagggcctgcttgctatcaagagctagcagggaaagtcggttgctttttattattattataattattaagagtttcatctcagtggttccattttgaagagaaaaactgatctcttagtcagccctcacctattatagaacatctaggaccctggatgtttttgaggaaccatccaacaacagtcttgtgataacatataacataaaacaacactgtagttacaagaacaaaacacaccacacattatacccatgaattattatcctttcctatgtttctgacaactctgggtttttggttaagaaatattttgtccttcttttaggcatgaatctttttaggaatgatacatttaaataactgaaacaaaaatgtgtgtataaagtttctactcttaacattgatagtttagctttcaacactttaaaaagttttaaatacattccaatgcaaaaacaaatgaataaacatgcatacaaatacatatataaaaccttagaactgaattcacgtaataggactatgtagagaaataaaactacgtgacttgaacaaattgaagtacggatgcacctcatcatagcttctataaccttttaattttacaagaaccctcagttgttgaatgtggatgttttctcttctataacacacgcagctctgcaggtgcacattactttgtttcttggttttctttgactctcccaaatacatttattcccagttccttaaaagttgcatgtttacattgatactagtggggacattctttccacttcaaatttcggaaaataggaaaaacaacacaaaaatacaaaatgctcaaattgcaagaaagaactacaatcactagctgcactattgtcatttttttttcttttttacttttttgtttgttttagtttctacatcagccacatacaaccaggcaatgcaggaagctgctaatgtggcaaatgttatatcaggtaataacagaattgatattaaaggttacacattttaatctcctcggaggaacctcttagggaacatgaaagatcagcctgagttaaggagaggcagtacgttgtaaccaaaccagtttgtgttcgctgtggctatccgtccccaacaacttctcagcacatcctacctctcttcctcccaagttctttccatatccgtcacgtcactttgtttcctctgcagttacattaatccaagctcttgttagcccaaagctcaactacttacatgactttctcaagatctttgttgccatggtctctccatttctagtccacctgtataatactatattattgaatactttattcactatctccccattcccagttcaaaaccttcaatgacttccccatgtctctccagtatcctcttcaatctgtcttttaacatacacaatatgccccaaacacatcaccaactatgcttcacctttatttccttgataagcgtttgctccctggcaggcctgtttatccagtactccatgcgcagtgttagctcagcatctcacctccatcatttgtctgaatggagaaggaggctccccactgccctgtctctctagaagccggcgtttcctctccgtctgtaaatgcatctgaagtgcggtcgctacttccacatgtgtgtccccacatgtgtgacacacgcctctcctctgacctacacaagcacagcacggtgctccattactattttcatgtgggcgtctacaagaatctcccactgaagctatttaatctgaaagttagattcctccaccctgcgtggttgctccagcgttaatccaggcatcatcttcgattcctccctctacctcacttcccacagcaaatccacacacctgaccgccctgccttgccaacatagttctcaaaactaaatatgacccactctttcctctgttacccatgagtccagctcacagccacctctggcctgggttcctacagtcgcctgctgattcttctccttgttccctaccgcctcccccagtagatcacccctgatttacaaacagtcaacttgtccaggttacgagggcagctagtgcagccaagctcacacccaggtttggctccaaagagtgctcaccacattcgtgtgcacggctgtgtcccctcatcccccccacacacggaggcaccatctgttggggaagccgttttcctccatccacacagcgtcacttccacactgtccttcacaccagctctctggtgcattctattgattttctttgtcttttttctttatctatctatctatctatctatctatctatctatctatctatctatttgagatgtagtctcagtcactcttttgctcaggttggagcgtaatggcgcaatctgggctcactgaaacctctgcctcctgcgttcaagtgattctcctgcctcagcctcccgattgctgggattacaggcatgcaccaccacacccagctactttttgtatttttagtagatatgggatttcaccatgttggccaagctggtcttgaactcctgacctcagtttatctttccacctcagcctcccaaagtgccgaaattacagttgtgagcctctgcacccggccgttctgttgctttcctttttaaaattcactttctcctctcaatcatagttggcttaaattcgactttcaaatagggaaaaagcataccgatattctgccactttttttcaatgtggtgttctatataaaagagaaaactcgtagtatgtaaaatttcactatattcctttgaatcatgagctaacataacatctatgtaacttctatttaatatcttaattcagatattcagattcaaggggagtgcattaaaaattgtacacctctgttggctttaaacaatttggctttctaaatatcacgttaaatataaaatttaactttcattattcttctacatttgtatttacttcatggaaattaaaacctggtttatttaaattgtataggataaattattttttatgtaaatgtgattttttagcttaattagcaaagtattatgtaaacataggtaaattatactttatttacataatgtgaaacttcaaattttctgtttacttgttactgtaaacctgcaaacagtcaatatgacttgtataatttatggctggagattttaggcacaagggcctttgagttaattatgtggttaaaatattcagaacacaacttgttcaaactatgcaataaccaacaagtcacaaaaatgttcacagcattcctcagtggtcttttctttgacccccactatgtataagatactccccacacagagaggagtgacaggaagagtaataaaggattcagagaaataaatattaaaaaaaacttgtgttttggcaagtccagaagtaattatttaaattctacttataatgattattcaaccagcaaagtgctttgatcaaaacaaattaaaaatattggtctattaaaaaatagatttcatgaaataatacagtaaaaggaataaaagttatatttaaagaaaatgtggaagttaaaaagttgtcaaaattatttcaaaaatcacattaaggaaaaatattcaagaaaaaggacctactgaattctgtttggaaatgatttaatacattcttaattcacgtcattcttctcataattgcttaagatgatatgctaattattggtagtgttaagaaagagaatcacatttctttaaaataattttccaaaatacttctattctttttttaaatatgcctactgaaacttaaagacaatatgcttaattatcattttaccaaagataagagtgtcataatatggtcataatatagtctcataatatgctgaagccaatatgaagttcattgccttacggtggagagcacagcagccctggtggctgaagtgtcacgtcatgattctcctggagcatcagacacaggaaaggacgaagccaggaaatgttgccctcgggtttcccatactcagttggttggaacaaattaatggaggttttgcctgtttgtcttccttttctaggatgaccttaaatagttatcaatacatgtctattaatttcaatggattttgaaattgtcctctttagtagaatttaaggaaaaattttcttctcttaaggagaaagtatttctctaagaataatcagaattacgtccctcttaagcttctaagtagtgctagcaatgaaataaaattgcccccttccctgtgatatgtgctacgtaatattatgtaaaagtagcttcactttttaggcgcataaaatgtcttagcagagttacgtgagtcccttttcctcaatgacatttttaaatagagaactgggagcactgactatttaaaactctgtacggttcttacaatgcggagtctaattttgttaaaattctgttgtttctccattgctaaatagtccattttaaggataaggcctcttccagtattttaccaaccttgtgactacaacttaaagtagaatatgttaaatacaggatacatttatacacaccagcacaccaagcgaggcttgtgcctttatcagctttcctaagtcttcacagattttagggagtgagcattgattttgaagaactcgttgtggggctctttattggaattgttttcttgctactctatgtgaggtgtatgtcctacaattataatactgagggatagaaaggagcggtggccacgtttgcattgctgagtgccagctttaacataattatcttccagcaatgcagcatataagtaaatacttttaaaaatccctctgtttgctgtttttctgacgtggagcaaaagtgcaaataataacttgagtaaaagaaaattgataacttcattaaaattcatttgttttatatttattttcttccatggacatttcaaattcaatgatggaatcattctaactacaacaaaatatttattgaatcagaattttaataaaattggaaattttattagattattatttttttctaatttgcatcctcattattcacctttaagactgcttttggcagggcgtggtggttcaagcccgtaatcccagcactttgggaggccgagccatgtggatcacttgaggtcaggaattcgagaccagcctggccaaaatggtgaaaccccatctctactaaaattacaaaaattagctgggcattgtggtgggtgcctgtagacccagatacttgtgaggctgagacaggagaatcacttgaacccaggaggtggaggttgcagtgagccaggattgcaccgctgcactccagcctgggtgacagaccaagaccccatctcaaaaaagaaaagaaaaaaaaaaaaagactgccccttatgttactaataatgtagacagcatccattagtaaaatagttatggcatcccttcgccaaatatttctattttttcattcgacttaaagaatatatgttctttaaccacgcaccagtgaattattaattataacccactacttcaatttttatatgtgttggtttaatgtttaagtaaaattgatttaaaactccactagaacctactagagataaaattaggaaattgatgtgctttctttcacttaaattacttaagttcagggacgttcttttacaattctgagaattcgtgtatcacacttgaaggtcaggtgagcacacctaaatattttagtttctgttgtaaaagcaagataatccaagacatgaagaggtgtacaaagctttccatgaagcagtaggagttatttctagctgtttgttttttattttaaaaccttcccatgtattttcttaaaaaaattaaacacgtccaatcaagactagggtgttaattaaaaaggagtaagagtggaaaatctgacactttgtaatttatttttaaggcatgatagataatgactcatgtttaatgtttctttataaacgatattacctagtggctttaactttccttaattagaatctaagctctttgacaacagggcttacgtgataacttctcaaaaacaagccaaaaatactttttaagacaatcatgtactgtagtcaaaagtggaggttacactcaaaacagtatcaagccaattaagactgtattctattaatgatgagcttccagagttaaacatagcaaaaggtgtatttaagtgtaagttaagttttgctcattcgaaaatttacatgtcctatgataaatcaatatcaaatataattcctttacaaaacaggctagtagagaaagtaggtttccattatagcggcattctatctgaaagtcagcaacgtattcaacaataatacatgtaatattctttcctcggttcattccaatcaggtccctgaccccacagctctgcaggtacttctctgtggtgagatcccaccaccattcattccagaagcctcagctctcaccctccaagaccaaacacactcggtagactgagtggcattattgcccataacaaaaatacccccaaactaatgaatgatgttgtgtcaataataattaaaataatcttgagctagctttctgtgttgggcacattctatatgttaagcactttactaagcccattaacacatatttcttcacttattccttagaatagtgcacataattttattatccccatttaacctttgagagaagaggtataataactaagtaatgcaagtcagaatccaaattgtgttaaatcagaatgctatataagacttggatatatggaatgtgtcacttttttatatggttcattaccttttttgaaaactatgaaggacacaaaaatgagtgaaaaataatgacacagaatgctaaccatgtaccatttactaattttcttctcagagaacctctgaaaatgtcttctcagtgaaagcctgtgctttcccccataccgagctctcttctttccttctttcttctttcaaacatctacaagttggcaggcaccccactaattcctggagaaaatgtgctgaaccagatggacatgacccatgtccttatggagcttataggtaatacaaaaggcaggcagccaaacagattgtcaccataaagagtggggaatgtcttgccaagcaatgttttgttaagcactggaatccctgagaggattgtgttaagtttcctgaatcctacatggtactatttgtcagaagctctggcggcaagaccagaatatcttcattctctacaagaataagttttgagaccctcagcaaggggatctgtatgcaccaagggagcacagaacaggggtgtgtgacccttcgtggaattcaggaaagaccttggcaggggagtgctttttcgctgaatataaaaatgagtagagggggaagattgcgggtggaacacagcggtgtcatggaaaccaggagactagtgattccagagggagggatgagtccacatgctgagggatcaatgtgtttggtctgggagggtgggagctgaggctgttggaataaatggtggtgggatctcaccttagagaagtccctgcagagctttggggtcggggagctgattgcaatgaactgaggaatgagctgaaggtgaaaacatgaagacaatgactttgggctttactctcaacctggttgggtgggaaggggagagagagagaatacatgtgggaggtatagtctcaggaaatgatatttctttttaaggtttgagagatttagttttgcatcctaaccagtgacatgggttgaaaacaaagaagaagatggataaccagtgaagagagatgttggggaatggatagagagagacagaggctgagaaattcagtgagtttggagaggaaacctgagaaaaggtgttaccgacaaagctctttcccgcaaaagtaagacgtttccgtcttctgtgctgcaaagccagtatggtaaatcaaaagtgaactctagctttgcaggctgtattcaatggccatgcaattgagaagtgggaacacgactcgcaaatctacttctcagcttctgagagccaggaaggcagagatcagtcatctttaatgaagggattgggcattaaaaacaacgggaagaatattcatgtctttactgagaatgggcagtgtcctcctcacagccccactgcagctatccttcctctttctccttttgtggtttcctctagtcattgttactgtgattgtcaaaggtcatggtgctgggggagtgtcatttagcacagaaatgatattctaataaagttagacgttcttcagaggtcaagtgagcttttctcttggataccaccgttcttagcctgtttggtcacaaggggaaattttgacctcaggcatccttttttctaaagatgagcagagttaagcagggtagaaattcacctaggtcacgtaaggtaggcattattatgctaggtgacaaagggaaaataatgctaaaataaaaataaatgtgagacaatataaaagagaaaatatagaaagaagattaagagaacgggagagacagaagaaagggtgcggttgagagtgtgggaggcaggatgccaggcagagacacgagaggaagaatgagcaaacacaaaatgagaaagagtaagaatgtgagagtatcgaagaagaaagatttgggaatgagagagagacagaaagttagacagataatgaaatcaagtgtataaggacagaaattatagccagggaaagcctcgccttgctttttgacaccagagaggataaaaataataggtttcattacaggtggtttggaaagaaaagggacagaagttgggtggtttctacttaatttaacattgagagaattaagagcatctgctcaaaatgcaagaacagctatgtgtgttaggtcatgttctttgagaagcaaattcagacttgcaagtggttccctggggagtgtgaatggtccctggaaaatcacctgcaggaaggagaaggaaggagagtgagcaagagaagttgaactgtgaaaccatggccatggtggacttagccgttccttgggagctcagagctagggtggctgctaagttgtgctgagatgccctgaaaggaggtgagaagagtgggtctttgttccatttccgcaacctcccatcacccagagattgaatgccagttgctccaggaagaaaggctaagcttggatgacgcatctctcttgggctagcccaaggcagtcactggggaggaacttaattccatgatgtacatagcgttatccccattttgtaaatgaggaaacagaagctcagagcaatctggtaatttacccaaaccacacagctggttagtgagtttaacaagcttcaacccttgcctgattgttgccaacatttacttgcagtttactctcttatgctaccagaaacgtgatgaaatttgacaaggatgcatgcaaagttttcatctcagactaagaaatttgtttcacaagttcattcactcagttgaaaaagatgtaagaattaattgaccagaaactcaataatacttgtcaatgtcatctatctacctgggtacctgaagaagttcaggttgcttaaatacttgatgaatgaatgagaaagaatgaaatcgcttggtgcattaagaaaagtctcgcgtctgcattgtactttattcaaggttaagctgcatcagtagaggagattggatgtaactctgtgggccctattttaagagcttgacaaattgggagttgaccagtcacttttgtaatgagttagaattccatgaatgtacagtcagaacgaattaatgaattagagtgtagtaatagtagtattttaagaaaatatgattttcaaaatgatttacaagtctgtctgcctgtactgaattttgttttgctttcaaatttcaagtttcagtattaaagaattagtgcttaatgaaaaaggctttggaacttctgtctgatgactgtttttgtggcctcgagtaagtccctccctcttggaggtcttccttatttgtctttgttcatgaagatgtaccagaagagtgatgtgatactttgtagctgtaaggttttattattgagtaaattacttatatgcactttttgaaaaaaattgcaacttaaatgtagcaataacatctacctcatagaataactagtaggaaaaatgagattaaatatggaaaaaatacgtttgttgatacttgattgcatctattttttgttgaaaacaggaccacacctttgttagtccttgctccttcttttaattacagtttttatttcaaggtaattgtagattgacttgcacttgtaagaaataatacagagcccccttccatccttacgcaatggtaacatctcacaaaactagagtacaataataatacagcccggatactgacagggaaactctggggacacagaacttttatctggctatcaggaagcttcatggtgtctttatgataaacatatttacttcctttaacttctggaagccacacatcttccctccatttttactattaggtcatttccagaatgttttattaacaatttgggatcatattagagcattatcctggaatcacacagtatgcaaaaacctagggctggtttttttcacttagcacagttcccgtgaggttcccacaagttgttgcaagcgtcgatagtttctttcatattcttcttcctaggcttgtccagcttattagggttacaaagaacggataggataaaatttatattaggaaagaattggagtatccaaggggttttaaactgtcagcaaacatgatctgagcaattaaaactcattttctaaataatcaaaatcaccacaatgtaaaatatcagttttttggagcttctccaatatagcttctttttccttttctttgagttgtgagatgccattcattttgtcttactccaagaagcttcattaaacttcctaactagataaggatgttcttattctatgcacagatttttggggaagaagctctgtcagggtccctaaatcaatcagatgattcatgtctagctgggctgaagttgcaggcactgtgctgccatcctcagcagagtctgtaatggtgacgccttcaaggccggtgacatctcagcctcagggttgtccaactggttggaccaatattccctgatttataaacacattcacttcctttggcaacatattgcttatgaactttagaatttgtggatagtttgcataaggaaaaatctaaattccctgtcacgcgcctgctgtggtaatatggccatctccttctttctgcaggtgctttcccaaattaccaatttttgtagttttgtttttgtttttgttttttcttttttaaactgaatgtatgtatttgcattagaccatgcttttgtcattcttcttcaagatggaacagagctgtcttgaggcactggaatttttgctcagcaggacttgaatggaaatgctacataaaagccacatgctttgggtaggggggtgggggtgggcaagagagcagaggggctgctttttctgttattgctaattgatgcctctattgctagtgctttccctactggtcttgctaatgttgtgccatcactaaagagggcttggcaaactctggaaggctcgctttcattttctctctcccaacaaggttgattaaggaatcgagttcctaacatcctaccaattgtccttttccttgaggaagtaaggaaaaataaaaacaggattaaaatgttagaggcttaatgaaagatgttttaaatgatttagcaattacaacaaaatcatgtaaagggtggaaatgaaaacgaggttaaaattaggaatttaaaaaatttaaatcgcatattgtttctaattctagattgcatttatggttgtagtttgtttttttttttcttttttaacaaaccaatattttttgtcacttttttcataaaagttgaaagatttttccaatttttgtcttttcacttttatttattttgtagtaagggattactactctacagagtaaaactaactgaaaaatcaggaaaaaatacattttaaaattctttctcttttaattattctgcttttataaaaataatttagtcataagagcagacatattgtggttttacctttccgaagacaaatattactagccattttcatgtattgatgcatttgatctactaattttaaaagggtttttttgcccacttcttgatggggttgtttgtttttttcttgtaaatttgtttgagttcattgtagattctggatattagccctttgtcagatgtgagtaggttgcgaaagttttctctcattttgtaagtcgcctgttcactctggtggtagtttcttttgctgtgcagaagctctttagtttaattagatcccatttgtcaattttggcttttgttgccattgcttttggtgttatagacatgaagtccttgcccatgcctatgtcctgaatggtaatgcctaggttttcttctagggtttttatggctttaggtctaacgtttaagtctttaatccatcttgaattgatttttgtataaggtgtaaggaagggatccagtttcagctttctacatatggctagccagttttcccagcaccattaattaaatagggaatcctttccccatttcttctttttgtcaggtttgtcaaagatcagacagttgtaaatatgcggcattatttctgcaggctgtgttctgttccattgatctatatctctgttttggtaccagtaccatgctgttttggttactgtagccttgtagtatagtttgaagtcaggtggcgtgatgcggaagacatttatgcagccaaaaaacacatgaaaaaatgctcaccatcactggccatcagagaaatgcaaatcaaaacctcaatgagataccatctcacaccagttagaatggcgatcattaaaaagtcaggaaacgacaggtgctggagaggttgtggagaaataagaacacttttacactgttggtgggcctgtaaactagttcaaccattgtggaagtcagtgtggcaattcctcagggatctagaaccagaaataccatttgacccagccatcccgttactgggtatatactaaaaggactataaatcatgctgctataaagaaacatgcacatgtatgtttattgtggcactattcacaatagcaaagacttggaacaaacccaaatgtccaacaatgatagactggattaagaaaatgtggcacatatacaccatggagtcctattcagccataaaaaatggtgagttcatgtcctttgtaaggacatggatgaaattggaaataatcattgtcagtaaagtatcacaaggacaaaaaaccaaacaccgcatgttcccactcataggtggaaattgaataatgagaatgcatggacacaggaaagggaacatcacattgtggggactgttgtggggtggggggaggggggagggatagcatcaggagatatacctaatgctaaatgacgagttaatgggtgcagcacaccagcatggcacatgtatgcatatgtaactaacctgcacattgtgcacatgtaccctaaaagttaaagtgtaataataataaaataaaataaaacgaaaaaagaaaggtttttttcttctaggctcataatgaagcggggtctgtaattttgtttgtttttgtgtgtttccttttagttttattttttaggtctttgacagactttgttatcaaaattacgttaatctcctagaactacttaggcaatctttgcccttcctctattttcaaaagatttcttaaaatactgggttttgttgtagttgtttttaaatgctcggcagaactcaccagtgaaaccatctgggcctgtcattttaactttaaaaaagtttgtaatatcaaatattaaatttttcttatacgtctgctcagatattctaccttgtgttagttttaataggttgtaattttctaggactttgtccattttacctgtgtggtcataattttggggaaaaatttattcacagtatatcttgtacgctctttaatgtccttaggatctatagagattttgcatcttttattcctaatgtagttaatacatatctcttctttttcttgataagtctcagtaatcttcatcaattaatctttcccctaaaatgcctttggctttcctaatttctctatttgccttttaaaattttatatatttttttcctattaacttcctgaggcagaatcttaaataattgagtttatatggtttttcgagtgtaatataagtatttaagctacacactcccccatgagcactactgtaactaaatccaacacattttgatatgtcttatttttctaattatttggtttcaactttttttaactttatttgtaacaatttatttgatccattgtgtattcaagtgttttgcttggtttccagatatttggggtctttaaaaaatactcttgttaccttttcctaatttggtcagagaaaatactttttagaatttaaatgttttggacttcattgagaattgttgcattgtgtagcatagtatctattttagtccatatctccatttgtccttcaaaaaatttatgtattctgcagtggttgggtatagtgttctgggtcaactaggtcaacatgagcacagcttcggttcctttccggtggttggtagggggaccccagttccttgtcatgtgagcctccctgtagggctaatttagtgttcccatgacaccgtggctggagtccccagaaggtgtgatccaaggcaaaaaggaggaagctgcaaagccttttataatcatctatattcagaaatcacagtttgtaattcacacaataccctgttgtttaaccctatcaaacctattcaacgtgggaggggaccatagagcttacctgctaggagacgagaatcgctgggcgtatttcaaaatgagctaccacaatgcttgtctgagactgttcctgctgcataacaaaacgccacagactggataatttataaataacagaagtttatttatcacaatgctggaggctgggaagtctaagatcaagagttcagcagatttggtgtctggaagcagtccaatctctctgcttccaaagtgttgcattcttactgaattacccaaggggatgaactttgtgtccctccatggcacaagggaggcaaaggcgaaaaggggatgaatactgtgtgaagcctcttgtataagggcattaatttgattcaggagggtagagtccccagagcctaatcacctcacaaaggccctgcctcttaatactatcaccttgggtctaagtctaaataagagttttggaagtaaacaaacatgaaatccatagcaatacctttattgaatttttatctagctatctgatcaaatacttagagaggggtgtggtaatttagcccagtcttattcaccttatattaaaatgaaacattatttttctctcctatggcagaaatgaaagaatagtcttcactgaagaaatacccattttcagtgattctgttacttttgtcttgtcgtgctaataaaactgataaaatttagcttctaaactccagaaaggaatataaaaactatgacatcatacataaatatgcaatacagttttatcttctggagaaacctatgtgttggacaagacagtcttgatcagtatcttcttttgcaagtaagaaatttggaacccagagagcttaataaaaccttattgatcatatgtaacacatggataatgtatgtaatggcatgattactcaccagtacattttggaaattcaatatgtagaattctgatacctgtttgtgtagattttgcttcacctttcacttgtgaagtactcacgggtaagatcgtgccttactcttaggtacactgtaaccgtggtgtgcacttgtcaagtaggagtcattgtttaaaagcaggcagtgatgatgggttttaaggaggagacaactattactactggggagctagaatgaacccaagtaaagattcatagaaatgcatggcttgtaaattgcaaactgagcaggtgtacctatgggggtgtatacatggaacgagtgaggaacacaaacatggagacagagactgttgtcagatgagtcgtagattcctagctgggccactcaccacccttttgatatctagaaaaaaaaaaaaacaccaatattcgaacataattttcttaatctttaaattattttttatattatttttacaactccatgagaagacactgagaaaaggggtggaaaggcaagaatatggcccttctgccccagcctatgaagatggtattcaaagggtcattagaaacattccattatccctggctactgttttctctcgtgatgtcactccctgctactaacctgatgaaaagagaacatgggttattaattgcataaactatttttcatcactacaaaaatatccattgggctattcatactatggaaagaaagcaagtttactacaggaataaattaatgtgaacccacaagaacgctgaaacaatgtgtctgtgtatcaatttagctaattctccatgaagaaatctttaatgctttccctaataaagtgtttttactttaaagtgaagtacatcaataaatatcttcagtgttttggcatcagatgtgcagctgtcttcattgtttcaataggcacaataataatttgcatgctttatgatgatagaactcagaagaatggagctgcctgatggtgttctatatcctgtttttagccagagttaaaatagacatgacaaaactgaatagaatgcctgattacagattacataaattatggaaagtatatttcgttccaagggatgcagacattgcctagtcacaatttgtttatctgctcatggtacagtacttgataaactcctatactttattctccatgggctatatctactcattcagttgtttcccaccaaacagtgggcatgtctctatagactaaaacattagcttatattcaatttatactgtgtctttttctcttttatatgatccagtagttgaataaaaattgtctcaaacaccaccctatttgaaccgaccctggtaatgagctgtataagttccattcgggaccactcttgtggtcgggtccatacctggacacaacaaatcagatgggtgacatatgatactgttaatgcaacattgtgggaaaaagtgaagagaagatagcttttcaacatacatatatatatatatatatatatatatatatatatatatatatatatttattattattattattaattttagtagagacaggttttcactacgttggccaacataatcttgaactcctgacctcaagtaatctacctgccttggcctcccaaagtgctaggattacaggtgtaagccagtgtgccaggcctgaaatttaaatacaagggttgccttaaagcaatctatggagaacaaataattttaaacatttattagcaagaatacagcaagttttttctcaaaaggatagttagaaatacatgtgaaatacagaaaaactaaaaaaaaaaaaaattatatttcataacgaagattttatgtttaaaaagttggatatcagccgggcgcagtggctcacccctgtaatcccagcactttgggaggccgaggtgggcagatcacaaggtcaggagatcgagaccatcctggctaacatggtggcacctgtagtcccagctattcaagaggctgaggcaggagaatggcgtgaacccgggaggtggagcttgcagtgagtcgagatcacgccactgcactccagcctgcgacacagagcaagactccctctcaaaaaaaaaaaaaaaaaaagttggatatcaaactcatcattatggcacagttaggtctgcattatcaatgcatagtgcaattacgtaatacgtttatatgtgtaagaaaattaaaagaaaaaaatgatgtagaaatgcagcaaagagttgaaaatagcaaactgaattgccattggaaatttgtaagctgattttaaagttcattatagcactttccatgtaaattatttgaagatttctctctttggcatgtaggcatttcttacaaacatattttttcctactccctactggtggattgcatttcttgaaatagcgctatttttttccaactgagagatgaaagaggaatcggagagcctggggacacacatgcagggcgagtatgggtatgtaaaggattttgtgatgatggcaaggtcttcgggaaggacattgctatattgggcatcaattacaagtcagagaaaggaaggaggcatatttaggctcaatttggtttatgtatctgaaaattcccatggaacagagtgagaacaacttttggaatgagctgaaaaatgcttatcatagggcaatagcattgggacaagagaataaagagcaaatttgagaatggtaagaaacaagaattaaactctgtcttaggaaacaaatacatgaaaaagatcaaatatacctcccttttgtcacccgggtggatctactgaccttgaatgaccagcagttcaagtgacagcaggaggaatttgataggcatagcagtggtttacagggaatgtgttgttttgaccagagtgacttcagtgtgatggtaaaaaagttaaacaatgcaagtaaactgaggtgaagcctcaactagacatttaagagtaatgatatgtataggatactcaaattaattattgcatataaaaattattaagagcttattataataaaagactgaggaaccattaaaagatacctctgataaaaaatataaattatatataatctatatgtctaccatatatatatatatatatatatatacacatatatatatatataggtgacaaatgggcttttacagtgggaggtgtcagtagagaaatggagtagctgaaattcacagagctctcatctggatttagagacttctctctacaccagtttttacccattgggtgcagttggatgcgtcatttaactttcttgacttcatcatactcatcactaaaatgaagtaggggcttaaaatatatatcatttatgaccaattatattgagaataagggttagataccacatagtacagaattacctagagttgcaatttttcttactattagctggaatttattcttcattctgatgatataattcagaggaaagtgttatccttgtgtaagatttttttactgatatccatgttatagttcaaaatttcagtagttcttcagactggaaagataatggaaaaaatgagaaaagagtagcctatcttaagttagcagttaaagcaaaggcatggctggccttgcgtgatggtgtatactctgatatggttgttgttcagagcctgaaatgtgaggtcattccccagggtgggtcagggcttggagagccagagatgagtagcagtgaaagacaagatatggctaaatgttttgtttggagcacgatgcataaggccttgttagagaataatccttataataaaggtaacaggcaactatcaaatgtttttaagtttaggacatgaatccttaatatattatttcattttcttttagctatttgtgttttaggtattcgtttttggctctatttgttcatatatacttacatttctagtaatgaattcaaaaacatcacctgctgtcactattacagttaaaatattccataaaccagagaaagtctatgcttattgtattagtccattcttacgctgctataaagaactacctcagacagggtaacttttaaaggaaagaggtttgattgacacacagttctgcaaggctgggaggcctcaggaaacttaaaatcatggcagagggagaagcaaacatattcttcttcacatagtggcaggagagagaagtgccaagaaacgggggaaaagccccttctaaaaccattagatcttgtgagaactcactcactgtcgtgagaacaccatggagcaaccacacgcatgattcagttacctcctacagggtccctcccatgacacgtggggattatgggaactgcaattcaagatgagatttgggtggggacacagccaaaccatatcacttatctttccataatatttataggaattaaaatatcccccctccaccctcccagagaaagaaacaattctatgttttaaaacttagagggaaagagtactgatttattttcttagtatatataaagtaccagtggattgggaaagattccaattataatttctgggctagaacagatatgaactggctccctgaggacaatagcctgcttcctttttcactctgacaaccatgaaggactgctctgtcatcacaacctcttgagaaacctggctagggtggaaaaattctgaaagggacacacaacctgagaacatgcaaaccgtttctacattgacaattttatatctataaaatgaatccagtgctccaaaacgtctcacaaatcaagacaatttccccaacacagtgtgagttatactacaataatagattaactccgctatgcagaacaaggaataaattaatcatcgtttaatattttaccagttacatatattctctaaggggatatctgacatttttagttatcaattcccacgaaattcatttgccactttattttacctgtaacaagagatttggacagaaaacatttacattagtattagcagatataaaatttattttgatattaaaaataacatttgagttttttctgttctttagcatcaaaaaaaaattcagcacttcatcttagagagctctatattctcttaggtgaaggtatttatgtttttatttacataaacatatatcaacaattcatctttattttataatactttgttttttagattatcctaagtccttaagctgcacatactagaatgaaatattatttacattttaaatgtgctacaaggaaggattttcagcttagcaaaatttaatcctgcttagtttttcgtatcattttgatatttactgtattcaactttgttctttgtctaataatactgaagaaatattattcactgtatgagcattatttactcatcattcatactggggttattacagtgagtaaagacaggcatgtccccatttgtagagttcatatcccattagggaaggcagactcaaactgtcacacaaaaatataaataaattcaaagtgtggtgccttatccagagaaactacttctgccacgtggaagtttaagaggagtgtgcattctggaggagagaaaaaaaactcagaaaattctaccaagaaaaaggcatcatggaaatgattatgtaccacagtcataactaaagagaactactttgcaagcaatgttttttttttgtttgtttctttttcctaaatcaatgaaattaaatggtctggaatctcaatgtcatctttatacaaaattttaacgtaccattgtcaattataaaaggatggatatttcacattaaaagtgagttctgcccaaatgtaggacagtagtttgaaatgatttgtggtagaataatttatgtcggatcctttaacttccactgggaatatttatggtagctcatgttctcaaatatcatgttttgtaaagtatcaaactttagattttcataattgactataaacaggtttatggacaaatgcttctctgaaagtaaataatcatgtacaaaaaacttaaatatattctatcttgatgagatagacattgaaaatactgctatcatttatggactaaatactacattttacattcagatgccaaatactgttaatctatagtttttattttctttcattgtttagctgacaccgtttcatgactttctttatgaaacaatttgtttttgctttctctggggttacaaaaagctgtataatttgtgtacaatttagcatagtgacattaactaatttggaccatacaagttatgcattatatgtatatgtttacgtggagagcatgatcaacttaaaacccatttaagctcacttaataaattatattacaaaatttgtctattccatatcaatattataacaaaactaaatgtctaaaagcagaagcaataaatgcatttttctttgaagtcattaaagcttcccaaagccaatgacaaagattttattatagtgatttatcaaaagaagcaaccgtcaaaaaccgtctgtatagattaagactacttgaaatatttgtatagctgtagactagttattgactatattactgaatttaaactgttttaaacccaactattaacaaagcaattttcaaccaattaataatgaggtaaataatttagcaaaattttgtatttgggttcattttcaagtgtataaattgctgaaatggaaaacagctggtgtctatacaagtcaatatttgcatgttggtgagttacttagaaataatctaaatataactatacttcagagaattattccccagaataaattcattaaaattcaattcattttgctttatttatctcaatactgaaaagtgaatatatccctcatactgtaggattaatagcatggttatttttatgccatctggcactaagacacatcccaggtcctctgaaagaatattggatgaggacagccagaaaatgaggagaaaatagaatctaagtaagacagtcgcacagaataacaaatagctcccaaaatttccctcagcttcttctaaatttactttttttagcttcattaagtacgaccttgctcttatgtgactaagaactgtcagctttcacaattcttcattttgtagtacttcagctaaatttctttactctcttctttcaactctaattttggcctatttttaccttctcatcatttaatgcacctattgctttttatttttaaaaacaagttattgttgtgagcgttctttgaagtgcttcatctcgattttttctaaaagtgaaatcacaaaagttttcatgttctgccaatttctagaatcatgatggtaacaggaaataagacatagtggatcataaagagaaaaccagaatgaatattgactatcatctacgctacacttataggtgataattgggttggtccttacatatagagtatattgtgtaattcaaggcaaaatctgatgtcacgagcaaaattttaaaaacttttgaaagaatgttctaagtggtaatatccaaggttgtgttgatttgactttttccactgtacatagaggttgggtttattttcaagcttctaaattgttgtagtggaaaagacggcttttgggctgccttgaaacctatgagcttcatactcaatttccatgactgtgaggctccatgtgaaggaattgcagagagtaaggcaaaagttgtaaacactttgttcatttctgtattcccaattcacagagttgaaatcattctaggagatccacagaaataaaggggaagccttccttaatcatgtggatgtttaattttcaaaacataaacacagaaaacacaaacacatacaaccacagaacctcatatttcttatatatatgaaaatatgcacaatacttaaaactatgtgattcctgtttagagctttcagcaattgcatggattatagtcacaattcccttcactacaagtgcgaaataataaagtctatctcccagagaaataagaattgaaataatataatggtgtaaaatgcttggtacatagaatgcagtaaactaaaggcaggtagctattattgaaaactagtatttgtacgtttgtgtcaagtagaagtaaatacattttgaaggcaaaggaaggtatttttttgtaaaagtgcaattcaggatggccaaataaactcctatgggattcaacccttcttcacttgcaactgtggatgaaatataaaaataaatacgtaaaacagaaaaacacctggaaactagtagcactagaaagttgaaaagaaacaggcagattccgaaggagttgaacagcctatagcgaatcatccattttttgattttcaggtcaagcatgtcagtgctggtggcaaaaccaaaactctatcctaacatccactttctttctgaaccagcaaaaccacatccaccagaaaatgagggaggaatcccagaaaggagagctctagactggagagccccacactgtggctgcaggttctgcccagactttgactcttgagctatgcctaagtggagcagattccaaatggggtagctgaggacagaggagttccatgagagtggatgtgcacaccacccccccacaacaggaagttttcatttgaatgcaactaacttaatttcctgccaaggaataaaaaataaaaccccaaagacgaaataaatatattcatcaactttttggaggagcataacagagtctaaaatctccaaaaataaaccaaattcacaattccagaaacaacaactaatcactccacatatttcagctagtttaaaataaagaattaaaaactaaaaggcccccaaaactgagaccaagcttgataggacacagatgttggaattagcggagaaggattttaatgcagctgttattacaattatgcttaaataagtaaaggaagcaatgctcttggtgaaaaaaagttagaaatatcaggaaaaaaataggcgttataaaatgaaaatcaaatgaataattaaatatctaaactacaattttttttaaagtaggtttacttggaaaggcttaacagatacaaaatgacataagagttagggagcttgatgatgttagtccaatggaaattatctaatcagtagaatatagagaaaataagactgaaaaaatataacaagcagggcgtcaggcttctttgggacaatatcaggcctaacagacgtttagctgaaactccggaaggagaaagagagggagaataagggagaaactatctttaatgtactaatggatgacattctccaaatttggaaaaaaaagaaaaaaaaagactcaagagtctctgtaaactgaaagataactgcaaagaaaccataaccatgtacaccacagccaaactgcttcaaaagagacagagaaaaagcttgaaagcagccacagaaaatggacgcattacatacaggaaacaacaatttaaattattgctgattttacatcaaacaccatggaggccatccatagaaaacaacatcattaaagtgctaaaagcaaaaagaaagtaaacaaagcaaaaaggaactgtcaacctagacatttatatcacgtgaaaacaaccttcaagaatgagggtgagtcagaaaatcagaggaagctatgacagcttatgagagggtgtcagtgacaggctcgtggtggaggaaatgctgagatggttgctcgggcttcatggaaacaacctgtggtgaaaacttggatcttcagtgacgaatagagagtgttataggtggtggccgggcacggtggctcacgcctgtaatcccagcactttgggaggccgaggtgggtggatcacgaggtcaggagaacgagaccatcctggctaacacggtgaaaccccgtctctactaaaaatacaaaaaaatagccggccgtggtggcgggcgcctgtagtcccagctactcgggaggctgaggtgggagaatggtgtgaacccgggaggcggagcttgcagtgagccgagatcccaccactgcactccagcctgggcgacacagcgagactctgtctcaaaacattataggtggtaaatattttggttaatataagaagacattttctctgagtttctttaaagtgcatgagactttttaagtaaaaataacaacattatgttttagagtttgaattgcatgtttgtaatatatatgataagcataccaaaaagaaaagacaagaaacacagaaaaaaagaggtttggtaaatgcacctctaaaattgcattctttatacattttaaaaaaaataaaattggtgtaatatttacaagaagactgaaaaatcttgggtgtttctttaattccaagagcaaacactaaaacactgcgaaaagtatagttaaaacaccaataagttaattaaaaaaaattcttaagaacattgaacattctaaaggaaggcaggaaagaacagaaaaacaaaagtagagaagacaaacagaaaaaataatactgcaattttatacaaagtggtaaaaaacaaaaacaaaacaaaacaaaacaaaacaccttactgttgcagtaccggatagaagacttttgtagaagtcttcatttcgatattctttcagtagtgagttgtcgagtaattacgtgtttaacaccaaaacaggagtttggaagataaaggtgaagtagacagcattcctaaactcaaggtgcctagagtttagtgggagaaagaaagggaagtataacatgagaatgcaatccagtcggagaaacaggagccatggcccaggaagctgcagaggcttgaggggaatacaggccagatggtattacgctgtggccactggcccaagatacatctgcatggatgcctgtgaatgggaggcggagagggagggtggtaagaacaaatcatcgatcattagcaaatgtcaggctgtctgcacatttacttacctagagataatatcctgcgaaagacaaaactgtatttcctttacggtgaatatcatagatgctcatggaaaactcggaaaactcagaaaacagacgaaagcataaagtaaaaatcaccagtggttcaactacctgtagataagagttggaattttgttgactttcagtttttaaaaatggtcaaaaaataatgacctcctactagacaaagaattcacagtaatctttaccaaaatttttgattttctcatctgtatgacaattttacattcacgcctcaatcagagtatgtggttttatgcctacccatcatagtatatatttgcaaccagtctcctatgaacaatattgtagtatttcccttcaggaaatcaaaatggagtccatgacaaagtctaataaaattgttttaagaaggagtaaatagtctatagaaggaaagaataaaacataagcaaagtaaaaatcaactactgggttatctttccaagccattcaacgtttgaacaaaggagaaaacttaaattgtaaattttgctaagaatttctccacaaaattataattattatttggttattataaccatatttttacatacataatgcagtgcctaactagatggtggagctgcattttgatacagtacatgaatgtcactgataccatgaattcatgtcagtagttttattatgtaatattctaatctgttcagaaaatcattattttatggtacagaaatacacagcgcaggcatagttatttcttttttccccactagatatcttgaaatgagaataatagttttatcttttccattttttttatcttaaactcacagttccactgatatggtaacattatatgaactagatatgttttctgcaatcattacaaacacctcatttgagaaggtccagtggcctccagaggatacattttatgtttctgcattttgtgtcgtaaaaactaaacctgttttgtttctgtaatgatgctatgtgttatggtgtcatgaaagacttctttctaaaaatatacatttaattttctgtaaccgtgcttttcatgtctctccccagtgtgaaataaaagtcacactcccatggctgacaaataagatcccctctctgctttgagccccactctcatgctggcctcacagctctcccgcaatacactgtcctccagctacaaagtagacttctcaactctccgaggagggcaacctttgaggggttctcctcattttcttctgcttttaacactgcacggaagatttttctgcccttctgccacccctttcctaagaaaaccctaaatgactctctatagacccttctgtgtggctctgcaagaagacactcactgttgtgtccctttttttctttttttcttttttgagacgttgtctccctctgtcgccaggctggagtgcagtggcatgatctcggctcactgcaaccttcgcccccactcagggttcaggtgattctcctttctcagcctcccaagtagctgggattacaggagcgcaccaccatgcccagttaatttttgcatttttagtagagttggggtttcatcatgttggccaggatggtctccatctcttgacctcatgatccgcccacctcggcctcccaaagtgttgggatcacagacatgagccactgtatctggccccattttagtaattctgtttacaggaaaacgttcatacaattagttgtccaaagaataacacgttcctttatcaaattacactatctaacatggaaagtttaatattccacaggacaagttaggtggtgagactgcattttattctttttgaatgaaatcagtttatgtagggtcattttggatgaataaaagaattgataattaataaacaaaaatgctgttgttgaaacttattctggctttaggtacatgtaaagctatacaacaaaattaagttaaatgcatttaaaaattttgaaattaaaaaaaaaagtaatttatttcatgtgaaaagaactgatataccactgtataacaataataaattctctgggaaatattcattagtctaggaaatactgtttttctaccaaaatccagtttaactcccgaatcactttaaaattccctgaattataccttacttgaaaacgttacttaacgaaaatttagtatggcggagatttgaaaaaattctatctcggctatgattcttagttttcataattatctgtcttgaacatctgacttcatgtagaaaaaagatgataaaatagatgcaaagacggaggatagcctttcacccagtatctttcatccttgctttccctttggttttgcatgaagtgactctgtggaaacacatttgaggaaaaagagccttgtacccttctctgtgtctgaatttcagtcttcgccatgtggcaacacttgattttcatcatacacaaaactaagagctcatgttgtcttgtttctcagttgtggagttgctttagaatatactcattaggttccaccctgagggtatttacacaatacaaatagcatttgtcactttacttaaagcataatgttatagttacgtttgttctgtgaggctgtgttaaatcagcagtgatcaaggctactgtgtgtgtttgtgagtgggtgttgtcgctttcgcttttggagcacaggcagagcttgcattcgtttctcgcccctttccgtatttgcttgtggtttggattgcatctcagtcttcactctcgtcccaaacaaaatatactatcatctaatttcaggttggatagaatagaaatgttcttggtttgatgagcaaaaacatccacaaagagctgttagtggttagtaatgtggtacatttcccttctgggtataatcacgtgaactacaattaccacatcatgtaacaagtctttaatggtaaaatttcaggtagatacatttagaaataatacaaattgttttctatcaagtcaatagattaattaatgcttacatcatttatttggaaaatattatcgggtagctagcatgtgcaaggcactctgtggtgttctgtaaaattaagaggacatgccaaacatccctgcgctgagtgggacttagaaatacacacatacaatgacagaacgggctaggcagcagaacacctttaagagccagacataaacggttaaggtcgtacagagaaagaagggatacctcagaggtgcagtgggaacaggagacaaagaaggaaggaggcgttgcccatgactggcagttgaaacagtccctaaggagaggtgaatgtgaatctttagaaataatgggtgagtcttccaaacagagaaaagagcttgaacaaaggctcaggaggggaagctcagaactgttttcattgttttgtaaatgagccacctattccaggctttcccattcctttcttagggctccttctgacttcctccaaggatattcgtggagaagggtctccttcccctattttatttttcacccaaattggacgaacatcaatgatttgtcagttttctctaactctcatttttccctgggccactttgttcttctttgagcagtctttcttatggaagacagtgaaggaaaactttgggtgtgtgtgttttaaaatatattccaaaaaaagaaaactcctcaagcagtacagttattttctggaattcttatttgctgtagttccccaaatatttagcatttatgtgtttggtgatagagcctatgtttacataacctagcacagatacatgtggtgttcctacttttgatcttccagaagttggtagtgtcatggctaaaaggcattgcctggccttggtgcatgagcttcattcatgagtctcctttacatagcatttgagcaagaatacatcttttagcagtgaaaaaagattagctactatcaagaaacatacagtttcttgataccgtaacttcactttgaatcagtgtcatgacctttgtattagctaatgtacattcagtaaaagaaaagccaaatttcctattatattgattcaattattctctagaagttttacaaaatgaaaaatttttaagactgtaggaccataaacttttactaactatccatgactttggtgaacaccagccttattctggttaaatgtaaaagttcagtgtgctactgagggggatggggaagcactgcccaacagagtcagtggttcttgaaatgttaactgcactgtaattgtttatgtgtttaggactattttctttcataagaagttatgaatggtttgtatcagaagtgttttgtgtaaatagtgtcagtaaaatgtaatttttaaaaaactctaaaaacataaactagaaaatgacatttttaaatcttcacaatttttatattcggtaaaattataatcagtaatttttagcacattttaatcatttcagattttttttaaaaatgaacaacttaagtggatttgatgaaaactgacacaaaagttagtgaatgcacagcgttaaatctagaggtaaggtttttttttttaagcctaggtcctattctcaatggaattgaccactttgtgaggaaacccatgtagatacacacattacaaacacagtacacttacatcacattattgacatgatatagatataaataacaagatcaccgggagtacaggaaggctgtttctaaatggactggattgtttccacagcagtactgagagatctcggttgtgaaggttgagtacggatactgggggtgaccaacacgccagggcagcagcagtgttggaggggagaatacagagtgtacctgccatagaaaccatgtatgtgaaggcacaggtgttgggagccttgccacgttcggaaacggcagttgtatgacagggtggaagtaggagctgtgtgttgacatcgatgcacccctcatgggtggcttcacttggatgttatccctgcctcacatttgcaggcacatgcagctctagacagctacagttttgatatatgaaaatttaaaacttgggcaaagcccgcagaagcttacttattctctaccttctcaacattgagggagaaaacaactgcagaaaaccctaaacagagatacaatttgtgaaagagagcaggtgactatgaaacaccatatggagcccaggaacattgcaggatataaaatatggtacgataaaaaagggaagactgacgtcaagtatttccatcagcgaatgaccactgggatgcagaaacaaatctgagccatggtgaaagctcctaatgtctttagtttgcacttttcatagtcaaacttttgaactttacatcagaggcagaaacaattttctaggaccctttgctgcaggagagtagattcgcatttcacatgggcttcacactgcgcacttctcaggagccctcactctcagctggtgtcagttgagcatctgaggcttctttaggtacactcatttccccattttcccaacacacactctctttttgtttaatattttatgatttaatgaaatctggatgaaagatgatttatcacctacatcattgtgcacgatttgatatttcagctacgtgtaaaatgctgatgtgacaaagtcatagtctactcctggttccttcttaccacattcaaagtgctctcagatagatgcaggtttaagtggaactgaatgaagaagtagatatgaaatttagattcaaaataaaaggcacttcccatttctaaggcagtggactccttacttaggtagcatgcctggtccatgcttatccttcctggtagaatgcccctcagggaggcagcacctgatgtgtccactgctggaagccgctgaactggaaacgtacgtggcaccttgtcagtgccaaggaatattgcttaaattaatggctggttcttaaggagtatttttcttggtattaaaactgtggcacacagaatagttctgttttgttttatttaatagacgcatataagacatggtatatgccaggcattgttctaaggacattgtattcatttaataatcataatttaaatatatactataatctatatagtttacttgtctgatatttaaatttttcatacacattttctttaaacataatttttattttatctttaaattattttttacattgtaactaatttttcttttttggtttttttgttctatgtaataactgtacatatttatgggatacatgtgatattttgaaatatgcacacaaagtctcatgatcaaatcaggataattatgatatccattactgtcaacatttatcatttccaaatcttctaggcattttgaaatacacaataaattattagctatagtcaacttacagtgctatcaaacattagaacgtttttcttctctctcatatatttatccctattagccaacgtttcttcctaaattatgtaactaacagtatctcttaataagtgtctggattacctatttccttattcctttatctggatgatgttgttaacagctttttatatagaagaattttttttttttgcaatgatcagtaatattgctgcagtttactcttcagtattacgtacaggctttcatttctcttggctggtagggttttgacacacaaagacctaaagtcagacatccgtgatgctgacagatactgggtttgaacaatcagattttactgagcatgcagaacctgcctttttttttttttgaatttgataatgctgatcaggaataatgacagtgtggctttgccatcatgggtcttgcacaaggaatctgtgtttctgcacgtgactactgaattgaaatctaataagtgctgtttttccagctttaagatcagatctgggacgtatcactgaaaacttttataggatatgtttcacgaaatgttgttcatgtcaatgccacaggtgatttaaaatacatttccccacttagaatggttattgtttatttatttgtagtgcatttgattctgacattgtgtcagatatctgagattcttagaaaatttctagaatacgtatgtacaaccgattggtctcattgccctcttattgcttgagaaaaagccattgtcaaatgaaaattcttctgccactctccaccctggaccatattatttagaagtccccagttgacatgctctattctgccaactttggttttattgcagcatttatgacatgatgactctgaggaaattagacttgtgtgaacctggcccgtagcttggaatgcctttcctcactcccgtcacttggcaagtcttgcgtgtttctggtatcagtgcatatcatgagcctccactgaccctctgctgaccctccatgcattctctgtgatgctttgccattctcctggcacctggctccaccacggcagctggcactctgcattttcaccacctgcgtgctctcctccccactacaccttgacctctcagacagggcagcagggggtttggcatcccctgactaagataatgctgatgaagaatctttcgttagtcagtaatgcataattgatttatttattcactttaccagtatgctcagaagttgtcaagtcatggaaagactgacctacatctatacagtgtatatttcttctaaagtgaagcatcatttaaaataaataatcaactgcaaatggagaactcctttttaggtactgaacatgcagagaggtgactcactcattagaataattaatttggtaaggaataaatgtaagatacttgaaaaatcataaaagatatttcacaccatcacgaaacagtctttccacacagtccatcctcccttgcagaatctgtctggtaaacaggtcctagtgtctggaaccagacaacttccttaccatagtcaagagcatgagggttattattctgtaggctttcttcactgcagcttctcccacattccctacttactttacagtttttatttaaactccttttgccacctctttggtttcttatccattttcagggagctataaaagtttcacaggttggaagagtgctaggaagctgatttaatctgttgtgcacttacttcatttcattttttaatttttacttctacttttctttgtctctgaatttttagtggttccttgttaaagaaattcttgtatgataagatgtacctctctgtgaagtcaatattccatgcctgtgtctaacttagaacagctcctctttcctctctaatcagcagggctgggttcctaaaagggctcatgttagaactgcagctgagggattttccatcgtaaggggcaaggatggggatgagatgagcctgctggagcccatctttatattctccataagatatcaacaaaaataatacaacaaacaaattaaatgtagatggcattttgtacatcataaattaatcacaatgggtattgtgaaattaattctcttttttgctttgcttgctcacaagcagcttgtcttatctctttcctccacactttcaatgagaagcttctatgttggtttcttctactgcaaatgggaaacaggcttagtgggagttttattttttgcctttgttttcttcctgtctggtcatctaaccttacatgattaatgcatttctgattttagtccttgccccattcctacctttttttaatctcagggtcctgtgtggtcccacataggtagaataacatgaatagctgtgatgctttgagcacatcttattaaaattcccatgtggaggagcaggcatttctcaggccttatctatgttcatgccaggtgccgcttctcctttgcagatcctcctccagtagccccatcgctaaggtggctgggacagttccgaaacccagaatgaccttcccctggaactcattcgcactgttaaccattgcagaggccacactccttctccgacatcccctttgtttttctattctaaaacctcagctccttccttctcaaataataacaagcatcattagaaattcaccaatatggccagaacttccaacactatgttgaataggagtggtgagagagggcatccctgtcttgtgccagtttgcaaagggaatgcttccagttttggcccattcagtatgatatcggctgtgggtttgtcatagataactcttattattctgagatacgtcccatcaatacctaatttattgagagtttttagcatgaagggttgttgaattttgtcaaaggccttttctgcatctattgaaataatcatgtggtttttgtctttggttctgtttatatgctggattacatttattgatttgtatatgttgaaccagccttgcatcccagggatgaagcccacttgatcatggtggataggctttttggtgtgctgctggattcggtttgccagtattttattgaggatttttgcatcaaacttcatcaaggatattggtctaaaattctcttttttggctgtgtctctgcccggctttggtatcaggatgatgctggcctcatgaaatgagttagggaggattccctctttttctattgattggaatagtttcagaaggaatggtaccagttcctccttgtacctctggtaatattcggctgtgaatccatctggtcctggactctttttggttggtaagctattgattattgccacaattgcagctcctgttattggtctattcagagattcaacttcttcctggtttagtcttgggagagtgtaggtgtcgaggaaattatccatttcttctagattttctagtttatttgcgtagaggtgtttgtagtattctctgatggcagtttgtatttctgtgggatcggtggtgatatcccctttatcattttttattgcatctatttgattcttctctctttttttctttattagtcttgctagcagtctatcaattttgttgatcctttcaaaaaaccagctcctggattcattaattttttgaagggttatttgcatctctatttccttcagttctgctctgattttagttatttcttgccttctgctagcttttgaatgtgtttgctcttgcttttctagttcttttaattgtgatgttagggtgtccattttggatctttcctactttctcttgtggacatttagtgctataaatttcactctacacagtgttttgaatgtgtcccagagattctggtatgttgtgtctttcttctctttggtttcaaagaacatctttatttctgccttcatttcgttatgtacccagtagtcattcagcagcaggttgttcagtttctgtgtagttaagcggttctgagtgagtttcttaatcctgagttctagtttgattgcactgtggtctgagagacagtttgttataatttctgttcttttacatttgctgaggagagctttacttccaactgtatggtcaattttggaataggtgtggtgtggttctgaaaagaatttgtgttgtgttgatttggggtggagagttctgtagatgtctgttaggcccgcttggtgcagagctgagttcaattcctgggtatccttgttaactttctctctcgttgatctgtctaatgttgacagtggtgtgttaaagtctcccattattattgtgtgggagtctaagtctctttgtaggtcactcaggacttgctttatgaatctgggtgctcctgtattgggtgcatatatatttaggatagttagctcttcttgttgaattgatccctttactattatgtaatggccttctttgtctcttttgatctttgttggtttaaagtctgttttatcagagactaggattgcaacccctgcctttttttgttttccatttgcttggtagatcttcctccatccttttattttgagcctatatgttggaagttctggccagggcaattaggcaggagaaggaaataaagggtattcagttaggaaaagaggaaggcaaattgtccctgtttgcagatgacgtgattgtgtatctggaaaaccccattgtcccagccgaaaatctccttaagctgataagcatcttcagcaaagtctgaggatacaaaatcaatggacaaaaatcacaagcattcttatataccaataacaggcaaacagagagccaaatcgtgagtgaactcccattcacagttgcttcaaagagaataaaatacctaggaatccaacttacaagggatgtgaaggacctcttcaaggagaactacaaaccactgctcaatgaaataaaagaggatacaaagaaatggaagaacattccatgctcatgggtaggaagagtcaatatcgtgaaaatggccatgctgcccaaggtaatttatagattcaatgccatccccatcaagctaccaatgagttccttcacagaattggaaaaaactactttaaaattcatatggaaccaaaaaagagcccacattgccaagtcaatcctaaggcaaaagaacaaagctggaggcatcaccctacctgacttcaaactatgctacaaggctacaggaaccaaaacagcatggtactggtaccaaaacagagatatagatcaatggaacagaacacagcctgcagaaataatgctgcatatctacaactatctgatctttgacaaacctgacaaaaacaagcaatggggaaaggagtccctatttattaaatggtgctgggaaaactggctagccatatgtagaaagctgaaactggatcccttccttacaccttgtacagaaatcaattcaagatagattaaagacttaaacgttacacctaaaactataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaacaaactaccgtcagaatgaacaggcaacctacaaaatgggtgaaaattttcacaacctactcatctgacaaagggctaacatccagaatctacaatgaactcaaacaaatttacaagaaaaaaacaaataaccccatcaaaaagtaggcgaaggacatgaacagacacttctcaaaagaagacatttatgcagccaaaaagcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactacactgttggtgggactgtaaactagttcaacccttgtggaagtcagtgtggcgattcctcagggatctagaactacaaataccatttgacccaggcatcccattactgggtacatacccaaaggactataaatcatgctgctataaagacacatgcacacgtatgtttattgcagcagtattcacaatagcaaagacttggaaccaacccaaatgtccaacagtgataaactggattaagaaagtgtggcacatatactctatggaatactatgcagccataaaaaatgatgacttcatgtcctttgtagggacatggatgaaattggaaatcatcattctcagtaaactatcacaaggacaaaaaacgaaacaccgcatgttctcactcataggtgggaattgaacaatgagaacgcatggacacaggaaggggtacatcacacaccagggcctgttgtggggtggggggagtggggagggatagcatgaggagatatacctaatgctaaatgatgagttaatgggtgcaggaccccagcatggcacatgtatacataggtaacttacctgcacattgtgcacatgtaccctaaaacttaaactataataataataataataaaattgaaattaaatgctttccttagtagcccaatatttttcaggactctcagccccggaaactatttgtgtattttaatatcataaataaattttaatgttagtttggcacaaacaaaaaaaaaagaaaaaaaaaagaaattcaccaatatggctgggcatggtggctcatgcctataatcccagcactttgggaggctgacgcgggtggatcacctaaggtcaggagtttgagacgagccaggccaacatggtgaaactccatctctactaaaaaatacaaaaattagccaggagtgggagtacacacctgtaatcccagctactcgggaggctgaggcaagagaattgctcgaacccaagaggcagaggttggagtaagccaagatggtgccactgtattgcagcttgggtgacaaagtgagactctgtctcaaaaaaaaaaaaaaaaaaaaaggaagccaccaatatccaaacagagattcagggttgagttcaattttcccaggaggaaatctgtgtagactacaattttccataacagagccttctagtaggggaaaactcaggtagggtgtgtttcattttaagtgtaatttacatatttttgtttaaaagcttaaatactaatgactcatcatttgtatgtaagtgctattttggtatgtttaaataagctggcatagtaaaaaagaaaatcaactgtaaaatcaacacttctgcttcagtgttagtcatttgaagtgctgaagagtcttgtttgtttatacagtatctagtcaagtcattctgttgtggatgacagcaagtttttatttgtaattaatacatggtgatttttcaaagtatattgttactttggtggcatttataattacattaaacagtttctgttttaatattttccattaatattttatattcattaaaattcttaacgttattaaatcttagctgattttgactcttcttctttatatgatattcattaaaattcttgacattattaaatttgagctgattttgactcttatttatatgaaatgctttacatatgtatttcatataatttattaaatttttctcttcaaaatgctgatctgattttggaatgtttagtgagtttaaaatatgtattggattaatcacttagtaagtttgtgaaatttacaataattataaaaaggatatttttgtaatctataaaaatttattagagaaggagacattggaatctttctagagaaaaacaataatacaaaaattgtttaacctgaattcatttgaggcaagtaatcctattgtctcaaaatggtttttaaaaattgaataagaaaattgaagttttaacttgactgcgtatgagaaattcatatttcaaacagtttctgaagtaggccatatttctatcatctactacacaaagctcaaagaaaatgtgttactaataatctcatgagtattctctctgattgtttgaatatagtatattcatgtaagtttgtgaaataggcgccttcttcacacacatttatatgacattctttgtatgctgttaaaagcagtgtaagtgaaaacttttgatgtctctttgtactttattgatttaaaagagaaaccccagagctcagggcacaggcagacgtagcctttgtatgtcacagaacatttcaatacattctctccaaacagtgggctgctgtggctagatagatggggaaggagcttctgtttccattgttgttcgtccacttgaaggtagatgtcatcatcaacccccagagaatgacacatcacaaaatgtccaaatgtttattttcctctgggcaccctcaggaattcacatgtattcagctaatgtcctatgagacactgtgcaaggacctgttcattacctatgtgttttacagtccgatggggaaataagctaaatacacctccacaattagactacaccaccaagagggttgaactccgcaagagggacatctcaggcatgtttgataattggatgaggtagggtgtagacgaaaccgacatgacaaaagcttccaaaatgcagtcgttcttgctaagaagaagtttgcttctctcccatacaagagtttaggggtatgatgggtgcctagctagggtagatggctcgggcggccatcccctatatgggatgaaggcaacagagatagatcaaaccacacattcctaccccagctccccagaggagaggagagaatgtgaagtggaagccacatcttcacttccccgtcacctcttaactctcaaagtcgtcatttgtccatgttcagctacaagagaggtggcgccaaatcatttcttctcatggccgtgcgttctgtgaaatcttgatggtggtaatgaggagttctgtacttacatagaaaaaagtggagaatggctgcttagagaccattagcagctggtgtagtgaactgcgacagagagagataggagtagcatttggctctcagtgaacttcctaagcaaagctgtggccatgttggggaaaacaattacatctcaggttcttaacttccttatatacttttgaatgcacggtaataaagaatgcacagatatgtgttaagtaaatacatttttattttcccttaattattatttatgataattatagcaactaatttcatgtatagtcaatatataaaccaacctactagtaaaagctactgaacatttttgtaaagctttaggcatttaaacatactggtttattctctaatctaagcccccaaatgccatcatatccagaggaaattcaagaagccagttctggagcattttcctcctactgccatgatgagctgtttgattttaacctgctatttttggggtatgtttctatgtatatgacactctatgcaagacaaatgaaatctgtagtaatagaaaggagatcagaggttgctaagagcaggagtggaaattgaggaccagcttgcaaggtcagagaaaaccacttgagataacaaaagtgtttcatattttgattgcgatggtgttttaagaatatattgcgttggccaaaaccttgaacttcagtagggttccccaccgagaccatgataaaaagcaggtggtgggagctattcacaccaaggtagaggcagtcagcgcacacactgtctgtagagaatttagaataatagtaaaactaactaaaggtcagtctgatttttattattctcatgcattcgcaatgctaagcactgtcagtgataaaatacttttctttgaataaatcttggtagtctaagttctaaacacacggtgctgttgttagtgactttttaataacgtgttatattttcaggcttcaaatttgcacctgtagttcagatttcactaactgtacactgcacccatggagaagcttcctgggcaaggggtcctcgtatcagccccttcttattccaatcatcctttcagcacacagcctcccaaggactcctctggttagaggtaccaattgttaccctttgctaaagtataaggccacttctttagctgagagtaagggggccctcaggttctgggtccatttatacctctcagaccctcattagccacttctctctgcgcctagttcagtacgtctggcattgtggtctatggactactgcattggaatcattgtggtatgagagatggagaggggtttacctaggccctgccccaaatctgcacagttagagtatctggaagtgggttccaggatgtgtcctcagatatcccatttttttttaaaacttgttcttttatcatgtggtgatgagctaaatatttataacattaatagcaaatatatacaccttacttattatgggatgattccttctatcagaattcttttccaaaggagatgcctaggttgaaatactggtctaaatacttaaattatatggagggaaaggcaagaatttcgtgattttctcagcttgcttcctcaaatttggtgcattgacgttctagcaaactaaatttggagatgctgatctcccactgcactctgaccctgggtaaagattatccatcttgcagtgggcaaaatcacccctcactacaagatatttgggatctccaatatggaacttggagaaataggtctttgccaattatattatatgaaaatagcatacacgtgagtgttatcattatactccttgtgcatatgataattacgcattaaatgtcagcgttcttctctaatcttttgccaaatggcaggctgtgccctgtctggactcccaccctctcagaaatcctgcagtactgggtgggcacggtggctcatgcctgtaaccccagcactttcggaggccaaggtgggtggatcacttcaggtcaggagttcgagaccaccctgaccaacatggtgaaaccctgtctctatttttaaaaatacagaaattagctgggtatttagtcccggctacttgggaggctgaggcaggataatcccttgaacctgtatatgacagggagacagaggttgcagtgagccgagataacactgttgcactccagcctgggcaacaagagtgaaactctgtcaagaaagaaagaaagaaagaaaaagaaagaaaggaaggaaggaaggaaggaaggaaggaaggaagaaaggaggaaggaaagaaagaaagagaaaagaaaagaaagaaaagaaagagaagaaagagaagaaaactgtcagtattgtatggtgtccatcacacctgggacactgggagccctaccaaaaccagcagtggtgtttctttgcctttctttaatccctgcttgccttctctgttgatttttggaaaataaattggccttgatcagtacagaaaatttatcctgctcaccattttatcatagttttctagggccccacagaaacctacaagccccgctgtgcacttagcacttctgaggacgttgacagaggtttgcttgattgttggagttgcttttctctgctgattcgaagttgcattttgtgctaggtcatggaaatacagaataacaacaatggtgcattcaatttatacgtgtagggcgctttgaattctgccaaagcgttttcaaccttgcggtctgatttaactacattatgctactgggttggatcagccctccgggatcatgccaacagtgaaagaagctgccgagtctggctttacttgtacatatcttttttttttttttgagtcttcaaaacttagatgagcttttgtgcaggctttgtaaaactgttgaagaaatccaggaagcttggcattgttcccacaggcctggtccctgggaggctgtgctctcagcagagattctcagcagggattgtgctgccatttctgctttctactcctggtcttttttcttttcttttcttttctttttcctggttctccctttcaataaagatgctgtaactcagggcagtgcgcttcaaaacaaagccagagaggatttcaggcatcatgttggggtgggttttctggctccttcctccttaaaagtagggcatgtcactcctcctccatctgcagcctttctccaaccaagtgagaccttatcatggatgggaatataggtcacttcaagactcacgtaaaggtaggcttatttttaatctgggagtattagaagtgccctttcagatccagaatcttctctaaaattttaaaaattggcacttgagataaagatggtaaattcaccgtttcagggactctgaattttatacacttggtcaattagggcatttatagtttagtgacttaattcatttactcactaaatagtttttgaggttggggcttggatggaagtggggatgtgtaatgggtccaaaaaaagagaacgaataagatctagtatttgatagcaccgcaggatgactcttgtaagcaataatttaattgtatattttgaaataaagtagtatgattagattgtttgtaacatgaagaataaatgcttaaagatttacccctccaggatgatacatacccccatttaccctgatgcaattaaaattcatcgtatgcctgtatcaaaatatgtaccccataagtatgtatatatgcaaaaaacaaaaattaaataaaattttaaaaattaaaaattaaaaaagtttgtagattctctgctcttgattaattactttagtgggtgctctgtgtataactagcctcctttcgtattccttaagttctgctgctcatagttcctcccttccaaagagtataggctgcaaggaagtaaaaatacagaagtttatagtggagaaactgacaaacacgaccctagccaagtgatcaagtcaacatccagagtggaagtcccactgatgatgcgtgtccctggcatgctgcgacgagaagtgttctttacctctgtgatcttcccaacaacccacaacctggtgcactgtgagaaaacaccagacaagttccacaggagggacattccacagaatatctggccgcaacttctgaaaaccatcaaggcccttaaaacaagggaggtccgagaagctgccccagccaggagacacctaaagaggaacggcacgtaaacgcagtgtggtatccgaatggattcctgaaacagaaagcgaacgttacttaaaagctaagataattcaataagactttagtgaagaagaatatgccaatattggtcactgattgtaagaaatgtccatacaaagctaagatgctaacagtaaggaaaacgggctgtggccatttatggagattctctactatttttaaactttaaaacaaatttttaaagtagtctaaatttgaaaatttattaagaattcataaaaatatctatacctatgcttgtcgattagtaaatataatgttattttatgcaacttacagagcaatgaaatattaaaccctaaataaaaaagacagagcaggtagtagttgggtataaaaatctagaagtcaggtaagaggttggccctagagaccaaagtgtagattccaatcttattcaaaaaggggattcaaatatgcatggtatttgaatgccagggactgggtgacatctcgtaggcagtagttttttgagctgggggtaatttttctccgcagatgacgtttggcaatgtctgcagagatttttgattgttagaactctaggagcttggagtgctatggcatctagtagatagaggccagagatgttgcaaaatgtcctacagccagacaatctccacagcaaataattatttcatacaaaatgccagtgatgtcaaggttgagaagtctacatatggtatcagaatagatagagaaagacgcaacacctaagatagactctttgatgttacaattaaagttcaacagaagaataagaaagaatagctgtaaaaataaaagaatgtggagagagcaggatagaaaaaaatggaggcaattcctaaccatgaaaggactgttttgagagttgttgagatgggtggtgagtcttgaaaaggtgatcattaacatcacctctttgtatcaaccttagagaaattcacacacatttatacgatagatttatagtagaaatatttgcagcatttgaaattggaaaaattagcaaatagactatttttgtatgtagcagctgtaaaaatgagcttgatctatctgtattgaacacaggcttctaaggtgtactattgagtgaataaagcttgtgactacatatactgtataataacattcatgtaacacagatatacacagctttgcattttatatagttctatagatatacatgtatgtattaataaatgcacccaaatgtgtcaggaagcacattgatccaatcacactttcctctgtggttggaagtcagattgacacccaaaaattatttaagaattacctgtttggtgtgtgctgtttgtatacaaactctggagccacaccacctcaggtcaaatcctggctctcccttttacttggtttataaacctgagggatgttccttaacttttctgcctcagtttgttcatctttaaaatggggataatagtagctactgcagaatcttgttgggaaaataggagagttcatgttcataaattgaaatatgtacacagtggtttgtctaggaagcattgtctgtgttagctgttgttattaagaatatggttaaaataagttattgaataaatgaaagactcccctctttgtgtaaccagctcaatcttatgctcataattagtgtaaaaatgtgtaggtatcacttttcattctaatctcagtgactaataacaaagaacggtatgttattcaatatgaaaacatccatacagcaccaacaaccaaaacaaagtctgactgcgtacattcattcttttcaccttaggcaagtatgtttagaaatcagtcggggtctaccctgagatacttatcaattaggaatgcacaaaatatttggaaaagaatgaattctacatgtcattttagtgggcaaaacggtttgatctctcatacaaagacttaaagctctcaggatgaaaagaaacaaggcctaaggactcaacatgacattatatttttgggaaaacaatcctaatttttataatactacataaaatcaaactaaaggctcagtgatgtaaatattattattagatctgatcctctacttcatattttttttcaatgccactttcttattgaggtgtttcctgactacctaatgtaaaattgcattctctacctattcctatcaaaaaaataccattttctcttgatttatttttctccatagcatttaaaatccactgagctattacaaattttatttttttaatggtgtttcttctctctgcatgccccaaatatactcactgagggcgatattgcattcctagtgcctggaaaaatattccacacataatacgcattcagtaaatattcaacataatttgcattctataaatatttgtggaatgaatgaatgaatgaatgaatgacatatcacaatgttgccttccctgcatttacgctaccactaatctgagttagctataatgattcttaagaattccctgggaaaaatgccattttaatttcaatttattttttccgcaatatttcctgagtttccaagattgttcctattccatgagcaggaccgttcccaagggctttgggtagaagatcattttgttttcagaatattccactttatgtctctctccttcctcccttcctcccactccagaatacatgtgcctaccacttagatgactttgatgaacactagagtcagactgaaatacacatgagttactacagagcatctggcccagcacaggtcagataggtcaggctcacggaaccgttgcaggctgctctgcttcttccacagcttccattgaagccacagcttcaatgccatagagaccatttttaaagaccacatttaattctgtattcatttggactccaggtgttccctctatgtcacaaccctatagggctaagtcatgcatcagggagggttctggaaagaaaagagcatgagatctgagacaaaggtggagttaggactcaagttccctcttggccataagcctctctctgcccatttttagatggcctcattgtcacattctctgtggggctcctggaagaattcagggaaataatacatgaagtgcctggcgcttagagttcaataattgttagttcacttgctccccaggctgtgcattaattacaatatgtgtgtgtgttatgggggaaacagaaaaaaagtttaaatcattaggtcatttaaataatatctacatccttttaaaatcaaatggaaataaacattcccagtgtatatcctatctgcacacttgttgtttgttatgatggaattatcaagactcaacaatcaacagtaggtcttcagaaattaaagaaaaatacctggaagcccacagttatactatgtacagagttgaatacatgacgtgtaaggcaacagcaaccacaaaacatgctttatcctttccgaaagactcttttcatgaagcttgagctgtttatgtgaattcagtaacagaaagcacatttaggtttgaatgaatatgaaaatcatggatttgtaatatactaatgccaagtaaattaaagtgtttataatgataacattgagtctatttttagaagctaacttccaggacaaagaagagaaataactgaagttagactgagaaacagccaagaattcaataattagaaataaaagataatgccacatgacctttatattgttaaaatgcttttattattttctacacacacacgcacacatacacatataaattgtgtgtgtatataaatttatgatacataatacatatatatcagatatatatgagctatagaatacattattatatgttatataatgtgtgtatataaattgggagaactgattttaaaatctaatctgcatgagtcctaaattttatatttgaatacaattgtagaaccattattttgaattatatccacttcacaggaatctaatatactttgatttgaatgacttagatgtatttttccagaaaatatgtaatacctgtgtgtgttcaccagcatagacataaaaactctaattaaaaaaaaaataatgcagtgccagagtctgaaagaaaaaggggatgatgaagatgctgagaagccatgtctcacaatgtctggaaatagctttaaagtgtgtaatttagtctttgtgtttcacagttcactggtgttcacacgttttattttagtctttgaatcttatggttactgctttgactcttaggttctctacttaaaattatttctactacaatccatcttgtcaagctaatttccccttttctatgttgcagctaatagcaggaacattcttgagtttctttcattctaaagcattgcacatcctctttctgagctgtaacagcatctgctgcccacagggccccatgatgtccctggatctggtcttcccccaactggggacagtgttctgaccccagcaccagtggcccttccgacgttctcagcagtcatttctactgctgtggccacttgtcattgatgatcggtaatgtagcactgttttaaatgacagtgtccttgaaaccgttcgtctgctcatatcatacacaattgatggtccttttacctgcctaaccctataaggacagaattcctgtagtatatgtggggagaaatgagaggctttgtctcacttctgctcctaagctcattaatgggacaactgtcgcccacattgtgggttcctcagagatgagtacctcagcacccggtaccccagcccacgactgcgtggccgctgcaggtgggagggcacaggtggtgactgccatgttcagtgtctccctgtgccccgtctgtggcctccacaccatacctcaggcacaaggctttcctgtaaatcagctttgtaaaactggaagattcaggcataacattgtaattataaaacaggaagtagaaactcctccgtgaacaagatgttgaatataattactctcagatgccatggggacatttttttaaatttaactttttgtgggagaagtcagtctgggcctgagggctgcaaagttcaggatggtgcagtccccagcatggtacaagcctggggtgctactcatcgaggatggttcacatccagggtggtacaccctcagggtgctacacggctagggtgctatgtggccagggtggtacatgcccagggtggtacgtgtccagggtgctatgcatccagggttgtacgcagccaggattgtaggtggccagggtggtacacgcccagggtggtacacgtacagggtgcgctatgtctcttcttattgcacgagagaagaaaatgagacccggatttaattatccttccggtgaccgagctctgccgtggtagaatcacagatggaatgaagtgtcctgctcctcctgactgtccttcctccctctggaggggtcgctggtcccctgagatgtgaccctccagttaaatcgagttaagcagcttttatggtaaagaattttagagcttggaatgacacaaagtagactgagattgcctttagcttattaagacaaggttcttatcagtaaatactaaacagaattgcattgtgttatttttaagtgttgcatcaattttcagagatgatttctctgtttttcctttgccatttttatattttttaatttgcaataaggaagtatgagaaaataagttatttgtatttgaaacagcagttattgtgcagatccctcaacttttagaatgaatgagtccaccccaactctcatcttctttcttactgttaagatgagaacatgtgagccagaaaatatcatatcaaataatatcacagagacaagcaatgggcaagaaaagacaggaaccccagtctcctaattattcagcgtttttttttaattaagctttgccaaaattatttctttctgacattacagttgcatttaaaagcatttcaattatatcaacacaattgggacaatatggtgtggtggaaatatcataggtctatacagattcaggtttatctgtgttatcttaactgagttccttagcctctctgtgtctcatcatttttgtatgtgaaattggaataatgatgcctcatttggagacgtgtaaggtttgaaataccatatataaagcgttccagcatttgaaagagctcagcaagatatcaatagtatctattagtaataaatcttattttaaggtaattgaatgtgtaattcagaacactgaaataaatgtatggtttcacccaggaaccaccactcctagaattaaaaaatgcatttcgtcttttgaaattccagtttggctattctacattgatttccccctcaaggcggccagacagcagcacacataaagctatttgtcttttctcattattttactgttatctatttgtctgtttgtatttaaaatacttttttttgaagacaacataacactgggtgtatttttcatccattatcatgatgtgcaccttgcaggtgtgaggttcatgtcatttacgcttcctatgtttattggtgtggctgtatttaattttaccaccttgcagtttgctttgtatttctcattcattttcttttttcctcttctttttatgttttccttttgttggattgggtactttctgtgattcgttttatctcctatgctagcctaatagctgtaacatttgtctttgctattttagtggtgactttagactttatagcagtctaccataatctactgtgatgttatactgctgctttttttattgttttgttttgttttgtagacagagtctcactgtctcacccaggctggaagtgcagtggtgcaatttccgctcactgcaccctgtgcctccaaggttcaagtgattctcctgcttcaacctcccaagtagctgggactacaggtgcaagtcaccacacccagctaattttttttttcccatatttagtagaggtgggtttttgctctcttggccagactggtcttgaactcctgaactcataatcttcccacctcagcctcccaaagtactgggattataggcatgagccaccgtgcccagcctgctttttttttttttttttttttttttttaatatgttgtaccacttcacctattgtatagcgaagatacagcaatgtgctctcctttcttcttacccagcctctgtggtattgctgtcatttctgtcacttctacatatgttagaaacctaaaatatatattatttggctttaaacagctaatagtgttttaaacagatttttaaaataaaatatattttataattccccatacgggtatcattcctggtgcttggaattccttactatgctattaccttccgctggaatgactcattttaatattccttgtggtatgggcctgctagtgacgggctttcagttttcacatgtctgaacttgtttctctaccctgtgatattgcaaaatatttttgtcatataaatttatttagattgatggttgttttgcttattcgttatttcagtacttcctataagttgctgaatctctccttggtttcattctttctgaagaggcatcacctggcccctttatctttgtctctctacacagaacattactcctacccccactagtagggatgctttaaagattttttcttcattgctgtatttaggcaccttgattttgacatgtgtgatatggtgctcttcatgttctttgcattttacacttactgaactttttgtatttatgagttcactgttttagtaaattttgaagtttttaggtaatttgtttccttttcttctttttttctgtccctctttgtgttccctgccttcagtgagtttaattacatacttgtgtctgcttggagatgtcccaaagttcattgattctctgtgctcttagttttgctttgtttttgcttggaaatctttcttttttcttttatgtttcattttaaatactttatcttgctatctctacatgttcattaatgttaccttctgctatatctattctaccttataacatccattgatttttgaatctcagatggttttaactctagatgttcaatctgggtttgttttgtttttttgtgggtatgtttgtttgttttttaatatttcccatgtctcaagacaacatgttccatcatcacctgactgagaacagggcatacagttctaataacagttttaatgttggtgttcactgattgaaaattctgttttatttctggctcacttttcattgattgagttttcttcttcttatggatatcttcttacttttttgcgtgcttattactttttgattggatgccagagactgtgaatctcactttgacaggtgctgaatatttttgtattcccataaatattcttgaacattctttcactggggtttggttgactatttgtggaacagtttgatccttacactactttttaaggctggatgtaggttgaggcacgaaagaagttgcttttttcgtagtagtaagcttgatttgcatttaacaattcttgtcatagttttgcgaaaatttatatatggattaattcttctagtgtttaaaatggcaaaggcccggccaggcgcggtggctcacgcatgtaatccccgtactttgggaggccgaggcgggcggatcacgaggtcaggagatcgtgaccatcctggctaacacggtgaaaccccgtctctaccaaaaatacaaaaaaattagccgggcgtggtggcgggcgcctgtagtcccagctactcgggaggctgaggcaggagaatggcgggaacccgggaggcggagcttgcagtgagccgagatcgcgccactgcactccagcctgggcgacagagcgagactccgtctcaaaaaaaaaaaaaaaaaggaaaaaaaaaaagaaagaaaagaaaatataggaccacgtgaggattcactagtgaagtcaaaatgtaagaccataagattatttaataattcacactagcaaatattcatgatgcttctcaagagccatttacatagtgaacattatcttgcaacagcatttttattttttcgattgtccggagctgctaaagtctttcacgtgctattaaaaatcttttgaaaatctagtctctaggtttcaaatccatttgccaactggtcgcttaccttgtttttgactttgctgcagtctctcctgcagtgtttttgctattatatgaatttgcctcgagagcttgaaacatgttttttaaaactatgttatggttgtgccctccattctacctaagaaaacatcgtaagtctccccaatccatatatgcatgttattataactaacctccattgtgaacaccgtagatctaatcacactttatcatcacctcttctgatgttagccacattttcatatgaaagagtttttgtcatgcttgcaagtagagattctgaatccatcatcatatgcaagctctactaccagttcttaacagttacctgtcctggaaattacttgatctccctgcagcatgtttttgtttgtgtgtttgtttgtttaaaatgggcataataatagtacttactgatacatactcaatatatataaacgacttggaacagtgtctagcacatagtgtgtgttgtgcaagtatttccggttattatgataaggcagaaataatgaagtggaattactattgctaaatgaaaaactacgatgtccttctccttcacttccattacaactatgctagcatttcattaatagccttgactctcataccctttaaaaatattgtttctgaaattgcgatatgttaaaatctctgtatactttgaaaattgtattatttccctaacatttgcatggtgctttagaattgggaaaataattttaacagtcctgacatgtatggggcacttaacctgtaccgagtgccctgatttgtgatatctttttacaattctctataataaacccaagagtaagctttacttttcattcccctttctaagatgtagaaactaagatctaagtaatttgtccaacattacaaaatcactttctggagcagaaacccaaatctatttgatgccagatctgatgactgtaactccctgtgccatatacttttctataaatgcttgccacaacgacttcccccacatcaatttatctttcttatttggccaaatcttgcccttttccaccttcaagtatatttacagctcacttcctcattgagttattctcagccagttctgattacgtcccatgaggtccttctctttcactgtcattcctcatcctggagaatgagactttttgaaagtagaaggcattcaatgactgccacctcctgggaggtcctcattgcttttgtcataaatgctttgtcagcaccttctccttttacagattggctcgcattcagagagccagtaaagagaagaaatgtaaggtttcaagactaggaaatccgattttttaatgtgatcctgaaaattatataaccagatttttctaatccttcccaaagccaggagagagagtggggtgaagagctttcagcagcaaatagtccaaaacaaacacatttgatatcgttggtttacatagaaagtacacatcatgaaggaatttggagttatattttcttaagctaccaggagactactacagaggcaaagtgtagagaaatggagagaaaccctaagggacctagattccagatgaatccacctcatgaaattccactgattgtacacatgctgttgaaaatgctgccgttgctttgatgaattttaaacttcctttcgatagccttgtcccatgtagtaatgaatattaatattgtattgtagtatcatgctttcacttttcttttggaaagatacttaatatgacatccacttaaccattgaaacagctgggttaaaggtttgatgtgatagcccaattaagtcactgaattgtgaccatatgtacttgccaaattaagtgttacggagggaattttcgtgtgcatatttagaatggcagcctatgtttcaagtttcaagccctgatgtacaaatttggcttcatggggtccagtggaaacctgccatgagagaaaacaactgtgcccagagctctttcaagaaatcctttcacgttaccaaatgtctgcattgggcgcagaattcccatcacctaaataagtattgctttcttgaagcatctatgggaaggagtgtaaatggctcaggaaataaataaagagaattaaaagtagagtttatgtcaactcagtaggtatttactaaattcttcatgtgtattcattacttctgggagtcacaaagagacatgcataatcttcaggcaaactggttaaaattcagttaaaatgaaattggcagaaatgacattgggttgaaataatttgctttcaaattagtttttctcgaacactaaattaccatattttggtaatatttgtgtctgtgtgtgtcttgaatctttgcatagacctagcaacaattccatcaatattttacaatttacaagtttttttgattttttagtaaaattgctaatggatttataatactatgtctgttttgcgttttttggtgtttgaaactagaagaaaatattctaatttattcttaattatttctatttattcacattgttcccattaaaatttttacaaaaactttttaaaaagaaaatttgttgaagataaaaatccccaatccctaaatcataaatttataactttgtgtcaccaatcagtgactttaaaccttaaatggtagatctaatcattttttcccatttgctgagttattttacttccaaactttttgaattaattttaagcctctgatacttatttacactttttaccaagtgtgggaataaagtgactaaaattatacattattttttgattcattgtttctaaaataacattttgtccaactgaattttgaaaaactttttttcctattcccactaagcttatgagctacgtgaatttcagttattgtacgtatgtatacgagaatatatgatctactttataatatattaatatttatatacaaacataaaaagattcaattccaacctggaatggttcaaggccctcagaactattaacggctgtttgcagtaaaatctgatagagtcataaagaacagatatttggagacctgttatctcattcaatcttcacaccttcccctttaaaatcaatactgatgggaaaacattttcagtagataagcacacctgataaatataagagacctaaagtccattctcctttccattgcaatccctgtcagttgaaaaacggcaccttgcaaaggctatgtctgatttgtgtttttcaaattcttctaaaattaagtgtcaagatgttaaggtaaagaaaaaaatctgtagagaagacaaaaaagcaaaccattgaaatggtctaagatgccccagaaatagacatcctctttattctctataatgccactgggctgttgcgtggagctgatggccattgctgttacagcaagtgctcacttcaagtgcttggtaggttctgggaaaatgtggctctaagcaaaacaatgtaagacaagaccaattttcccacaggttaattgatataaacaaaagtaaagttcctatgtcatattacttgtcatagaaaacatctacaaaattctaaatattaaagatcaaaacacttctaatattgaacactgacacacatgtgagctctacattcacttaagaaagattaataaaaacaagtaaaataatttatccaattattccagttttgggttgtgggtggccagagctgtctcagcagctccgggtgccaggtggtcaccagccctggacaggacacactaccatggcaggatcacacacacacacacacacacacacacacacacacacacaccccacactcacccatactaggatccagggcacatgccaatgagcctaacatgcaaacatggtcatctttgggatatggaggaaactggacatacctcatgcagagatggtaagaacaggtggtggccctggtcaggaatctatttatttttctcatccatgttataatgaaatagtggtgctgccaacagtgctatttgaggacctggtgtaaaataaaagcctgcaactgcatctgcaaaaggatcctttacgtcagatacaatgagaaatgcaatttcatgaaaagaacaggcatgctctccattgatgtctagttttttctttgacatccgctgcttctaacatctgccttaatttttccctattaaaaatacctttcctaaattgatgaaattgaacagaataaatatttttcatattcaattttatggtagtagctgtctcttggaagtttgaagagatgggtgtttacaaatatttcttttcagacaccttcttggggagactcatattcattaatgatatttttccttcagaaatatgtaagtcaatacatttctacactgctggaaaataccattgcgcagtaccatggtaacaattttggaggggtccctctttaaatttactaaatatactgtagatgataaagtgggaggcttgaccataacaacagcatcttgagatatgttacatgcagtcatgcatgacttaacaactgggatgcattctgagaaatgcatccttaggtgattttgtccctgtgcaaacatcacagagcacacttacacaaacccaagttttgcggcctactacgcacctaggatgtgtggtgtagcctagtactcctagagtgcaaacctgtacagcatgtggctgaactgaatactgtaggcaactataacataatggtcagtatatgtgtctctaaacatagaaaaggtacagtaataaaacagcattaaaaataaaaaaaagtgttacactctcataggacacttaccgtgaatagagtttgtggggctggaagttgctctgggtgagtctgtgtgtgagtgaggggtgactgtgaaggcttcggacgggactatgtacgactgtagacttcataaacactgtacacttagagtacactaaatgtataaaaacacatttttcttttttaatcataaattaagcttagtataacgttacttcataaacttctttttcatttttaagcatttgactcttccgtaataatatttaactgaaaacataaaccttgcacagttgtgcaaaacatttatattgttattcataagagtttgtctatttaaaatttctttatatgttcttactttttaaactgtattcattaaaaattaagactcaaacacacaccctagcctaggcctgcacggggtcatctcttccaccttgacgtcttgtcccaccagaaggtcttcggggcaaggacaggtatggagctttcatctcctaggataataatgcctccttttggaatccttcctgaaggacctgactaaggttgttttacagtaaaatcgtaatttttttttagtagaagaagcacactctgaaataatgataaaaagtatagtatagtaagtagaaaaaccagtgacagttgttcactattatcatcaagcatatgcagtgaacctaattgtatgtgctgaagatttgtatgactggctgcacaggtggtttgttcacaccggcgtcaccacagacacgtgcatcatagctggcactacgacctcatgacggctacaacatcagtacgccatcatctcctgggaccgatgttgtatatgagtcgtatcattgagctgttgttaggcagctcacaactatatattactgtagaatgtttcgttgatctttctgcacgataatcatttgcattattcataccaaagttaattgaaaaaaataatttcaggcccttttaacagaaaaaacgtatagaagagtcgcgcagactaagttccatttccagagtgtttcatttgcattttccgtgtgtgacaatgactggtcattgtggttatctttagcagatttatttgatagatttccattgataaccgtgtctttggggaacaattatctggacaccttctgttggaaaatgtgtgccttctaagaagaattagcagtagcagttaataataatgaccctaagaagacatgttgatttattttaaatattcctggacattaaagaaaaacatcaaaaagcttttgtccacatgtttactttttttaatcactccctttctcactcttcacatttacggtggctatacaacgtgtgtctttgactgtaagagctctcggctcagctgatggacaaggcattctgagtcaaaagttgaagggctgccctgataaaatggaaagtttttcttccttataaatgtcacttttaatgtactataaacagcacacatgtttgctttaaggatagtgaatgtggaattaaatacagaattttcttattaaaaaagacaaaaatgattgcagacaatagtgaactattttctgttgtgttttcaaacagatttctgtagactgctctcagaaattacttcttaaaaactagaactgaatacactttgactatgtaaatagagatctcataaacatgtcaataatattcaatatctaaacactagtatttatttcctaaatatttctatatagttctgtttgtacttaagtaatatcatgataaataaaaatacttttagaaatagatgattcctattccgtattctaaaaatgttctctatgttactcagtttaaaaactaataaaacagaaaatattattctacattatatcaatacattaaaatacacccccatgccgatgcaaagacaatggatacagacatgaaatagtttctgttcaattggaaatacatttttatttggaagtgtttgtatttctctactagtaagtttcatagcttacttgaatactaaatagcagctaatttactgatgacatactaaatttaaaccttagatatggatacaatagccaacaatgatgaatttcatccattcaactgaatgatgtaccgtttcagttcaaaatcatgttctataagtgtggaatggagtttcaagtcaattgatttagatagagaatcatatcaaggaaaaagtgagaggaccaaaaagaacagaatcaataccccattattgaaattgtcaatgaaaagagtcaaactgtgtaaaatatttgaagagatttattctgagccaaatacgagtcatcagtggcccatgacgcagccctcaggaggtcctgagaacaagtgcccaagaggattgagccacaacttagttttacacattgtagggagacataagacatcaatcaatacacttcagatatacattggtttggtctggaaaggcgggacaactggaagtgggagcttccaggtcataggtagaatcaaaggtttttttattgttgttgttttgtttttttgaggcggagtctcgctctgtcacccacgctggagtgcagtggtgcgatctcggctcaccgcaagctccgcctcccgggttcacgccattctcctgcctcagcctcccaagtagctgggactacaggtgcccgccaccacgcccggctaattttttttgtatttttagtagagacagggtttcaccgtgttagccaggatggtctcgatctcttgacctcacgatcctcctgcctcggcctcccaaagtgctgggactacaggcgtgagctaccgtgcctggccaggtttttttttttttttttttttttttcatattggaaattaattgcaagagttaagttattgtctaaagacatggaatcaatagagaggaatgtctgggttagaagaaagtattgaagagaccaatgtttttatcatgcatacaaagcctccaggtagcaggcttccgcaaacagattgtcagtgtttcgtatcggaattgaggagcctgttctatcagtaattccaacagggaagagagtataatgaggcatgtctgactgccccatcccaccacggcctgacctagtttttcagattaactttggaatcaccctggctgagaggatgtgtccattcagatggttgacggcctttgaattttattatttttttacaaaatgaaagtgaattcagtatttctgttgtcaaaacttagcactgaaacttgcttttgaatcagacactataaatggacagagcctggctgctggcctggaatacagtagtggaacatttttttatacattgatggatcaatgcatgagatttctaatttattatttaattcaattgcttatccatcaaatgttgattgagcgttgggtaatgatgtgtaacagacactgtaccagtcgtggaagcataaaaataaatagggtatgagtattcactcttgcagtatttcttatgccactgttttagatttctatagtctactgtgtctggttgctgacactgacatctggttgctcactataggagtaagtagaattttgtgactagaaaaatataatccagacattatctggaacactgaataaaagcaggactatatttttctctcttaacaaaatgcatttatttacactttatgatgtttataaaagtgttatactgcagatattctaaaacctgaagacattttctcagtttattttttagcaacaattaatatttttctgatgctagaggttttctcattttaataattcaaaaatggtgtctgttttatcttataagtggctctccatggaaaatttaacttgttttttctcctttcttttctttttccaatagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagaggtacagtgctacaagggggctggtgagcagactccagggcagggcaatggttttggagatgcttttatgaaagtttccacttaaatgaaaataatacatgttgagctgactcttacaatgtcagctcattctgctcctgaaagcaatattacatgttattactatgtaagaaataacatgtaatgtgtaataacatttaatattgcatgttagtatgtaagtaataacatgtgataagtaataatatataatattacatgttatacgagaaaagtcatgcttggaccacataaagtcaatagcaagtttatgacttctgatatgatttagctctgtcctcacccaaacctcatgttgaacggtagttcccacaattcccacatgttgtgggaggaacctggtagaaggtaattgaatcatgggggtaagtgtttcctgtgccgttctcatcatagcacataagtcttatgagatctgatggttttaaaaagaggagttcccctgcacaagctctctctttgcctgctgccatgcatgtaagacgtgatgtgctcctccttgccttctgctatgattgtgaggcttccccagccacttgggacggtaagtctattaaacttctttcttttgtaaattgcccaggctcaggtatgtctttatcagcagtgtgaaaatgaactaatacaatagattggtaccaggagtggggtactcctgaaaagataccaaaagatgtggaagcgactttggaactggataacaggcagagtttagaacagtttggaggactcagaaggagacaggaaaatgtgggaagttttggaattctctagagacttgttgaatagctttgaccaaagtgctgatgatatggacaatgaaatcctggctgaggtggtctcggatggagatgagaaacttgttcataactggaccaaaggtgattcttgttacgttttagcaaaaagactgatggcattttgcccctgccctagagagttgtggaactttgaacttgagagagatgatttggggtatctggaggaataaatttctaagcagcaaagcattcaagaggtgtcttgggtgctgtaaagctttcagttttataaggcaagcaaagcataaaagttcatgaactttgcagtctgacaatgtgatagaaaagaaaatcccattttccaaggagaaaatcaagccaactgcagaaatttgtataagtaacaagaagccaaaagttaatccccaagaccatggggaaaatgcctccagggcatgtcagaggtcttcacagcaacccctcccatcacaggcctggaggtctaggagaataaaagtagttttgagggccgggccaagggtccccatgctgtgtacagcctagagacttggtgccctgcatcccagctgctccaactgtggctgaaaggggcaacataaagctcaggctgtgtcatcagaggatgtaagcctcaagccttggcagcttccatgtggtgttgagcctgcgaatgtgtagaagtcaataatttgggtttgggaacctttgcctagatttcagaggaagtatagaaattcctagatgtccagatagaagtttgctatgggtggcggtcctcatggagaacctttgctagggcagtgcaggagggaaatgtggggtcagagctcccccacagagtccctactggggcaccgccctagttgagctgtgagaagaaggctaccatccttcagactccagaatggtagatccactgacaccttgcatcatgcacctggaaaagctgcagacagttaacagcagcccatgaaagcatccaggagggaagctgtattcttcaaagtcacaggggtacacctgcccaagactgttggagctcacctcttgcatcagcatgacctggatgtgagacacaaagtcaaaggaaatgattttggagctttaagatttgactgccccactggattctatacttacatagggccagtagaccctttgttttgaccaatttctcccatttttgaatggctgtatttacccaattcttgtgcctgcatttgtctaggaagtaactagcttgtattttattatacaggttcataagaggaagatacttgttttgtctcagataagagttcggaaggtggaatttcgagttaatgctgaaataagttaagactttgggggactgttgggaaggcatggttggttttgaaatgtgaggacatgagatttgggtgggtccaggagcgaaatgatatggtttggctgtgtccctaccaaaacctcatcttgaattgcagctcccacaattctcacatgtgggaggaagccagtgggaggtaattgaaccatggaggcagttctttcctgcgctgttcttgtgatagtgaataagtctctcaagatctgatggttttaaaaatgggtgtttctctgcacaggctgactttgcctgctgctatccatataagacgtggctaggtcctccttgccttccaccatgattgtgaggcttccccagccatatagaactgtatgtccatcaaacctctcttttgtaaattgcccattcttgggtatgcattatcaccagcgtgaaaacagactaatgcaacttgttattatatcccccaaatatccaaaattgttttcatcctgtttttcagtcttcatggatttctgcctattttcatcacctctcgttgtaggattcaaagatttgatgccaatgtttatgtccttctagccctgttgcctcctttttatcttttttattaaaaattacaaacactccttgaccatttaatgtgtatattttaagaactctttcaacactgtcagtcttctcagataaggtgattgtaagttagtgccctctcccaagtgccgttgtcatatttcagagcaagatgagaattcctttacctgcaacactgctatttttacattttccaaaaatactattttactgttccaatgactttagaaaagagcatacttcaactcttaggttttgactttcctaagaaaaatttatcttttgagtacaaaattaaaagcatacctaacatttattgaggtcttaatgagatgccagaaaatttgctaaaaacttcacttggattataccatttaactctcacaacaagcactaatgtaataattattaacactcatttaaaaggtaaagaaatagagttttaatttgcaaaaggttccagagatagtaaatgttatgacccaaacacaagtctggcttttaatctaggattgtaagcatgccaatttacaggctccactgcaagtcatcatgtaacattatattatttccttcagtatgcttttattttatccttcgctagttattgcatatttgcctatttttttttcctttttttgtaaaatgttagagtcttatgagatctgcttggtgtttattgtattcataatggcatatgacggcgatgactgctactactaccaccaccccacaagctagtatgtattgtccacttactgtaagccaggcactactttagcaaatttaatcttcataagtaggcattttattaaagattcatattataggtggggaatctggacttcaggtaggaaaagtgacttgctcaaggtatttgtgctaatagatgttagatttgggattaatcgtatttgaattattcctctgtcctagagaaattcatatgatgactagttcctactctagatgcccattattttttctaaaatgctcattttctcttcatgttcctgaagtttattatgtccattttcatttttttcttattaattacttttcatctttatgttgtcaaaacagtggtggcctcaaaacctaaacctgtatcccatctgctttccacagactgttctcaattaattgatctcacttaagagagtgccattgggcatcctaaatatattctttcttcttccttatttctaccattatttccattacattctcactctcagaaaaaaaatcaaagttactgtgtctttgttctctttatttatttaatttttaatagatcatgtagatctcaagtcatactcttcatttcaagtgtcttggccttacttccatttctgcctttactatgttattttagttatttatttcccttctcaaacagactggcttcaagtttgttcaatgggcccccatgtctaaaatgtcagttgtcatctgtattagtccgttatcatgctactatgaagaaatacctgagactgggtaatttataaagaaaagaggttaattcactcacagttctgcatggctgcggaggcctcaggaaccatgcagttatgatggaaggcacgttttcacaggacagcaggagcgagaagtacagagtgaagggtgaaagacccttataaagccatcatatctcatgagaactcacccactgtcacaagaacagcatggaggacccacccccatgatctaatcacctcccacaatgtgcctccccaactcatggggattaggggattagaatttaggttacaattcaaggtgaaattttcggtgaggacacagccaaagcataccatcatcctactttctactcctgactcactctctcctaacatccatcttcatcctaacatttcttttatcagccaaactactttggtgactcaatgagaataaagtacaaaccttcaacagggcttcctatatgcttcttacctcgtcgtaactaaatggtgcaattccacctggtagtgtacccaacatgagtgtaaagctttttgctccacaaagctgtgtttttctgtggccgacctatcctggctggcctgagaactatctgcttcttttccaagttctgtgttccttgacatcatgtggttagcttattatctgtcatagtgggactacagcataagaattggcaaacactgcaaagtaggttttcagtttgtttgtttgtttgtttgttgtttggttggtttttaaagaattcgctcagcagcatactacaccttgccaaattccaaacttttgctcaggtttttacactgccacagagtctccctgtcatctccctacagccataaatcttaatcatttgtcaacttcaaacttaaatctaaattttagttatcattacaaccccttattacagtttctttaaggaaaaaagaagtcccttgatctctcagatagcatttgtctgattgctattttatattttgacataatatcttaatggtgttagcttgtagcttcccaggagataagataccaccattaaaactgtgagtggcagtgtccttagttccttgtgacattaaaacttggcctaagccaagagtattttccttcattgtttattgcttttttgcttacatatcctccagtggttttcttcttaattggaggatctttaaaatttccataatcgtatctgtagtcaaagttgacataacagtcagctaagtgtctttcctatgctgccacccatgtggtaaatcccaatgagatcagtgtgcttttatcacaggaaactttgttcttctgtattatagattattacatttacatttaaattttgcttttctcagtgtctggtgtagtatgacttcaaattgcgttccattacatgttattttataaaacatatttgaatgatgcagcacagtttctcatggatttggataactagattataaagaaaaaatgatctaattcttgtaaatgtgtaaatgtgacatatttatgagagatgtaaatttcaaccatatggactgagataattcacacgaatgaaatgagtatatattctgcttccccaaagttctattaatacttatttatttgcaggaactggttgaagagttttttttttttttatagagttcctaacagtagcatgactgtctccttctacaatgatcttttgccagggttataaaagtttataatttattcaaactagcaatattttccctgaataatgacacctaaatgtattatatatgtagccgtgatgttctttaaagaaaaaggtataactgtatatttaattaatagaaaataattaacagaactaaatcagaggccagtcacctttgcttaaaactgtgtcccttaaacagggaacaaacatcacattgacattaaaaatgagacctcaaaattcatttttcttgagaggtaatctttcaactattcgttattcttgagtctttcaacttaagatctgtgtctttcttaattcaccttattcattgtatattattggcatgttctgccagtcttaaaaaggatttactgtttcacttcttacaggcatgatgtctgtctaggggagaaatatgaaaaaagagaagaagcagctagatagtttcaatgaaaaatgcttttgcctcttgatttaaatgccttcttaatttgctttatgtttcccatactttattattgattcataaattattaaataataatggtacagcctaggatagattataaattactttgagatctagggtcctacagggaaatagaggatcaaatgcaaaacaaggtattcttcctgactggaaaacatgaaagatggtccactgtgtggattttggataggggcatacaagaaggtagaaaggaagcaggtaaatatttgtatttagaaaatcctcctccatgagaaagctaacatctgatccagaacactcccccaggagggggtgcatttcttcacaggagctcacatccatggaaaattacagtctcaacatctcttgcagccccttcggtgtccccttttattccattgctccaattctgaatcttatttttgtgagtattagtctgatgttgtcccggctgcctaattctacctatgtaatcaccaaggcatcaggccgtttaaacccacccaggcctagcccaggccaatcgtacttcagacaaagattcatgctccctcacctgaacaccacctttttacatgctttcatttattctatgatggaacactttgttttagcaaaccttacttaagaaaacaattctcagcagcattgcagagcttagatccctgaagtcatactcaggaagttcccagtcacaagctgtcataaactacgtatgtttatgtatgccgtacttcacagagcggcctgcagtagctcctatgtgcaactccaatgaaccaccataggaaggtatccacaagtcacatttatgcagtgtctccttggcaatatgctgaggcccataaatgcaagatcctgcttgtacctcaaagaaccttaagaaatgggcagggaaaatatgattatttctgtaataagggtgaaaaactaaagtctcaaattgacttgacctctgatttaaatttctgacttggacattgtaacaagtcagctatagtttgggtggtctcatcccaactttactaacattgaagatcagtaacatatgaacatggttgaagagtttaataataaagttttcccatgaaagtaaaacttccatcagcgtatccatactcttatgccacagaatccataagatttaaccatttctggttttctgtcattattgtcttttatgtaatttgtttacattattcttcatgctttatccgttgtgaactttctcaattgacaccttgatatgagtattaatatgttacatcacttctgtttcccatgtcttcttactatctgttatatttatgaactggaataatacaactgattctttatgctgtatttctttaatttttggtaacatctcttgtctttccatttagtaagatgtgaatattcttgcttctactctttctagtatattttctctcctgttttggcctctatgttctctcaattgcaatagaacctttgcagtgtcaaatatgtcagcctttatatttaattaaataataataatgaagtcgctcttaatgtatctaaagtctgcttgtaaaagttgaaaagcagtggtcgggtgctgtggctcacgcctgtaatcccagcactttgggaggccaaggcgggcagatcccgaggtcaggagatcgaggccatcctggctaacatgctgaaaccccgtctctactaaaaatacacacacaaaaaaaaaaaaaaaaaaaaaaaaaaaaaaattagccgagcgtagcggtgggcgcttgtagtcccagctactcgggaggctgaggcaggagaatggcgtgaaccctggaggcggagcttgcagtgagccgagatcgcgccactgcactctagcctgggcgacagagcgagactccgtgtcaggaaaaaaaaaaaaaaaaaagttgaaaagcagtaagcattcatattttggtaagtgcgtgaatattgctcagcacagagccaagcgtatgcctgtaattagacttcctcttctgtgattccaacattgcaatccctaatgctactcaacccagagtctagatgagtgctggctttgcctcaattattcataatgaaattggaattacttttgtttcacatttggaccagggcattgttgttctgcttgtttcattaatacagtattaatgggctcaaacagaaatactctttgctcaagttaaattcaaaatgagtctcaatgatgggtagttggttcagatgtttttatgcgcagcggtgatttggagatggccacctttcacatctggcttccctgaaggtctgtagcctgcaacattgcactgggtgaaaaggaagaacttgagttgtgatgggcagttcctccacacattagagtgcatctcctgtacatccactgcattagctgaagctcaaccatgaggccatatttcactgcaaagagagccaggaaatggaagcatctgtgagctcaggaagaagaaaaacacggatttggtaaaagactgtcccatctttgccatactgctatttatttgccctcaaattttgaattatccttatttttctctcattacttagttgcacacttgctttcatcacaataatccatgtattttctgcttcttaactatgtgaattcttgctccgaatgaactctcttcttctttctgaagaccactgaattgtttctctaacttacacgattgcttaatatgtggaatacaattgttttctctgattcccaaagtttctagttgtctgttcatccagtgagttgtcacttcaccacagcttttcaatatcccacttgccttcatttcccccaaatctaccacatttctctccctgagcgctcacccagagggttccagaatggtttctaggactgtcgcaaagcagtaacttggaggcttctctttactcgtgccctcaatgcacaccctgtttcatgacaccttcttgtgcctcagtttcacctcaaatgctttctaccaaatgttgcttcggagggaagtctttaaacctgagcaaggctgcaaatgtccttatctgcatccacgcccatggatgtattggctaagtacaaactgtacatagaaaatatgtcctcccataatttttacagtgttgcttcatgattttaagtatgctattcacttctgctgaattggaggggtgttcactaaataatacttctcttccttgtctgaaatctgaaatacataagagataagcaaatgaatagtgaggcatagaccaaaatagtcagcacctttattaccaataacaatgctattgttatatatatatatatacacataaatatacatatatattaatatatatacaaatatatacatatttatgtatatatatatattctatatccattcatatatatatgtgtgtgtgtggatacatgctcccatatgtattcatctgtatattaaagaatgaaaaatataggcacctggactttccagtgttggactccagaattagacagacctaactatcctttcctaggcagcacttgactgaagctagttgaaaaaaataaagatcaaaagagctagtcagctttgttgatgatctggggtagtttgttttccttacaagctagagagggggatggcactatttcattgttatctctgagccaactagagccccgggtctttagtttctttaatttagttttatcactaaatggcttcttcatttgtcactcaagataaagattattggggaggggacggggataggtaaagggatattgcaacaatacatagagaaaaaaatagtcactccgaacaagtttcgcaggtatgcgccaaaagagaaaagggatggggagagagagtttaaaaagagcagctacatgtgataagtcatttgagggcatcaggataagacttagcatgaggatgatcccaggtgcacctgctcagaaggagctgatccttgctggagcatccacactctactgaggacgatgctggggatgtagcggattcaactgccacacgcttaaccaacaaaagccaggtccttagtaattagagcagtgctgtccactcaacatataacacaatccataatgtgagccacagatgaagttaaaaatccccagatgcgacacggaaaatgtgacatgaaacaagtgaaataaactttaataatggattttgtcaacctcatacttccaaaggattataattttaatgcagaattaatgtaaactgtaagtgaagtattttgattttcaaaagatgctagtttcaaaatctgatgtgtatttcagttatgccattttgcaatgctgactagccacatttcacgtgctcatgagctgcatacacttcaggctactgtattgagcctcaactttaaacttgttgtatcctctatcctcattattgctaatgcttgtagagctctgatgctgtcactgggttttattctcacttacgttgtagggtttaataaatagatgcagtttaatcataaagactgataaggcaatgggtctgagatatcaaagtccacgtcacaatgtgttggaaattcttccctttaagtttcagcaattgctgaagcatatttgagctgagtaggaccaaaaatagggtcccttttaaaattagtttaggcaaaagataagagtgagctaactcttgattaatctaaaaagttttctcaaaagaaatctcatttcagaccttatctcaaggttggaagtaatgacgttgggtctaatgaatgaagattacagaagactttgaggaacacgcggattcgctgagggagtaaaatgaaaacagctttgttatctgtcctggaataagtaagaaaaaataaagaagagtgattctagggacctagcagttttgatctcttaccataagagaattggaggcctttctcagacttctccatcttggttatgtattcttcttatctgagatgttcacccatccagaaagcagtagaggtgagatctggacccaggcagcctgaccctagcggtcacataaccaagccctatcctataatatcaatagagcatagaaaaagtaaatattttgaacagatgtcatgctcagtgtcagtttaaggattaaatgaaatacaacatcttgcagtcttgagcacagaaagaaggggattaaagtgcttgtcgtggtgaaacagcttgttcagcagctctgcactggtcacctggggcaaatcccagtgctgtcaattggacactgtgtgtctttggtcaatttatttaatctgtctggcctcaagatttttatgtgtataaaagtgcctacttgagaaatctgttgtaaagattaaatggcataacccaggtaaaatggttagcaaagagcctgacacatagagaaactctaaaaatatcagctgctataattactgtctctatctcctctcccttccactcttaagcacgattttagatttcagaactaagtgcccagagcggaatggcaaacagtttgaaaagaaattcatgtaagctacaggatctcaatattggtagctcttaaaaaaaagggtttttttttttttttttaatgaattactgctattctttagaataagaaactagcagactgacttgaggagagaaatggtttggggctcaggaaaaaggacaagagtgcctagtgaaagaaaggcctgtgtggcagtgggtcactttattttacacaccaccacttggacagaaatattgggaaaactacttctacaacaggcacattcatacccacgtgcatgtaaataactgacaaagcaggagcagcattatctcagacaactgccactttaagttccagctccctttctaacctcatgcatttcaaggaaatcacttgtcttctgacaacaagcagccagcaagagcagaccgtaaaacacagatacgacagctcaggcacagagggaatggggaatgtctcttgggtaaccaccaaacttcacattcatgcaatgggccccagtaaaacagtgggccctaataagggccctaataagggaatgttcccttccttttaggtacatgaagatagggaagctaaaagcagacttggtagtatgcttgcagcttcacggagatgtatgggaacagacacaaaactctccctcccagataagcaagagagagacacagaaacattccaagcctgtgataagctctctcgccctgaatctttaaaaactcttagtctgtaagagagagtgcctctgacctaactcagccaggagcctctctcaggtttattgtccataataaacctgtcttggactgttgagctgctttttgtgtttctttcctttttctttaagtcttacgataccatggcctagtacaaaaatatgtatctagcagtagtccagatatagacaatttctagcaaatggagtagcatctgtctcaaagcgataaagatttcatcttagtcactgtaattgtagattttaagaaagtgtggtaatcagagttaaacacaaagcaatcacaaaatgtcagacaatgtttacatgccttacgtatgttcttgttattaactttcatgacaagtctagaagttatatattatcatcatccctctggtttagatgagactccatcacagaggaattcagtgacttcaccaaggtcccacgctgtatgtggggaaggcagaatttgaccctggacactttggctacagagtctgtgccacggcccttgtcacatgctgtccgttctcttctaactcaagagaaaaataaatatttctaaaagaacctaacttaaaattgagaaacaaatattacaacttgaattaaacaagtgttttctccttgagaaacatgtgcttgaatcctgaatagtctgagtggggcagggggtgctggttgcctggagaggctctgcttttctcatcaaagcaggtaactggctggtcccagagagagggaagctgctgggctttggctgcctccccttcctccacctgctccttgtgcaaagtaggtacagctgtgttgacagacctgcagctactcagagattgcaaactgggagagaacaggaatcgaggcaggaagttgccaagagagaaagatgatggcagctcctcggcattatttgtggatgaaaatgaatacacatttaagccaggccttgataaaaatggccacagactgtaatcccaaaagatagactctcaaacaccataataccaaatgtttaaatcataaaaagtcagaatcctgaaaatataattctggaaaatatttttaaattatgtaaaagatgtgtatttattttttataaagggtttctttgaaaaaagacataaaaacacacaaaacactttgtaggatactttatgccatacaataggctataataaccagcttatttttgcaagcatacatacccacactagtgacagtttcatgggtatgacagttacgagtggacaaaccatactcatgaagcaattaatcaaaatgcaacatgtataaatgcatgccgctatagttgcccattgtgtgcaaccagctttatgattggagtcatcagaaataccgtgatgattagcctaagtcctttggtcagttgaaaaccatgatggatcaccaccagatatacagtcacccaaacagctgagatctccagaaatgttatcttttccaaatgcagattacaaagaggacatctcttcatttatttaggaagtttcagcatttgtaccatgcacacacaatgccgaggcacaaagtcaatcctgtgaccatgcagtttttgaagtcgaatttgaaaaaaaaaattcttaattagaactctctaatattttctacacaatttagagttataaacgaggtggcagctgggcacggtggctcacgcctgtaattccagcactttgggagaccaaggtgggtggatcatctgagatcgggagttcgagaccagcctgaccaacatggagaaaccccgtctctactaaaaaaacaaaattagctgggaatgctggtgcatgcctgtaatcctagctactcaggaagagtgaggcaggagaatcgattgaacccgggaggcggaggttgtagtgagccaagatcgcaccattgcactccagcctgggcaacaagagcgaaactttgtcctccctcccctaaaaagaaagaaattatgtggcatttgatattagaaatgatgagaagatgaattgcatagccttgaattgtgaaaaaaatagtgctgacaatttaaaatagtagaaaaaactttaaaaaaagatatctagaaggaagcttcaacatacacaaaagtgtattgcaggggtagatatgtacaattgcatggagagcgtccagcaaggctggctgaacaccgcggtcactgagtacattctgaagtcttgcctccggatgaatatctgcttttgttcctttatgatgtggctcttccttctgaaagtcttctatgatttctgttattgtgatttcagggttttagacattagggattttgactttaaggagtttcatcttttgagatttcaacaattgggattatggcatttgggattgtgtttttcaggattgtgaaccatacccaactaaaactgctgttcttggtctttgatagacatgacttccaacaacctcatggatgtcaaataaaacaacgaccaaaaaaacccaactatacacataaacttaggtcaacagagcccttaacccaagagggtggtttggctatagggtcttcctaacatgttacttaaaggctaaatctattttgctgaagctcttgctttacagagtaagacaaacctgtagaagacaaagcaaagagtcatctcttcacccaaataattttcctcatctggggaaaggctttttaggattgaggactaagtgaatcttcatcttttctcctctttccttctcatagccccagatccttcactaaaaccttggacctccttgtcctccaggaagcttgcattcttgggcagaggcctgagacctggagacgtctaagagacaggctcagtgcagctgcagggtcatgcatcttctctgccactggctcgatcatctcgggaagccaattcaggcaagaggagattgcaaaatgtctgagagtcagttggtcagtagttaattattccccatttattttctatttccatctactggaatctttttaggtacctatgaattactcaagcaggaaagcaaagggaatggagagatcacatgactaaatattttacttagactaaacctctctggcaagtgttacgttatgaacgttcaatgcttttatgcaatcctatctaaaatgttttatatgaacttttatatgatcccatcccaaaatttcctggtaaatattaatgggtagattttccagatatggaatcacattctctgagagcttagatgtcatgtccaaggctgaaagacagtggctgataaggccagctctgacttggtgcttttctacatttccctccaacggcaaccttcttgggggcagttgaagagacattttgttgtttgttgccatttgtttgtttctgttttgcttggaagcatgagatgtaaaccatagaaaacggcagcatacgaaccattattgggaagttacgccgcttgcttagtgaatgaagtttcacccttgtttttgtctgaacacatacatttaagataagtattcacctaaacatgtcaaaacacattgtcagtatttttcaacagttttagataaaatgggatgtagcagctgtcttgagttttttttttttttttttttttaagattcaaactgatttttatctattttgagactgttgtatttcttggagactgaatgatagtcattgggccaagatgccactaaataacatagcagtagcactgatacctttaataaaacatgctaaatagtgtaggcccattgttgcttttagacctatctgaagctgtggttttctttaattgttaagccttacgtaatgtgactggaaatggcaatatgtcacttgccaattctatatgaactgtcagtcgaggttttttaatcataggcattctgctactagagatgaaaaggcaggaaaactaggaacgacatagccagaggggagaaggaagagaagtcatgctttttatgggtgcctataaattctgcgatatttaaaacacagctgtgtttttatcaattatgtttcagcggtaacattgtaaaatgaatcttaaatgatctgtcacgtcaggacaagaaatacaaagtaagactgaatgggacagtttttatataagaaacctagctttcaattttttgagtagttttagacaatttggttttaagcacctttcttgcatactttgcaataaacaattccagtgtaaatcgtatcaaaattaaaactgttcaaaaaaatcagtcttagattctagtaaacctggtctacgtggtttgcatatttgctgtgctacattttctgccaagcacgtcattcacgttatctcatcccatacaatcttgtaacaggcttaaaaaataatcagaagtggctctgcccattattttcagctttgtgggttactttgtagtatttctaaaattattttattccatgcagataccatgttaggttatagagctgtaaagatgaatgtgtctagtgccagaatgaatccatgcccaggtaaatgcccttctttgtgatgggcagtcatgcgaagtgtttaccagcaaggactttgtcattctagctccagcctcatcacaagttggcacagctcagacgagctcttttcttgctaagacccaggctctgaatttgttaagttgggctaatattacttttaatctcacaggagtgataaagattagatgagatgatccaggtgcttaataccaataacggctattaggatcgcatagtagtccttgaagagtaagggggaacagacatcaaaagaagccaactcaatgtctaaaaagcttcttagaggctgaagtcacagaacagagaacatttatattctcctggagaagattagtgttaaatcatacacacttctatgtgcattgacataatttgattctcaatattttacagattattttctctctataattgaatgtgatgaatgtttcccatgttcacttcgacacgcaatgccataattagtgtctctgtacatatagcactgtgtttgttgcttctgttagatttttttcctaaggaaagatttctaggaatgttgtttatgctttgcaaacttaatgaatgcatttctaatgttatgacagttcaccacaattaatataacttttgatacttgcatttctttttaatttgctgagtttgagggcattgaaatgatgctcaaaagttgtttttattgcctttgatttccaatacacatcaatatttctccgtatgtcctttcagtatttacgtgtgttaattctttcttccaaggaacgtttattgaggacctgcaaagtattacatacacttatcaatcagggctggtaaacattttttgtcaaaggccagatagcaaatattttgttttcatgtcatatgatctctgttttagctacccttgtctgtcactgtagatcaaaagaccccatagacaccacctaaacagatagactggctgtgtttcagtaaagcctaatgtataaaaccagatactggactgaatgtaacccacaagctatagttcgccaacatttgttgtagctgctggggctacaatatgaacaaaacaagaaagaattccaatctttgcagaaatatcattttaatgggtggagatagataacataaataagcaaatgagaagcaacagataaactttgctgtcctgttgaaataagtgtttgtaagtgttctcactgagaagctgacatgtaattaagagctatggtgaccatctgcctggtcactgcctggacaggactctcctggtcttatcacctaagatcccatgtcctggaaacccccctgatagtagaaaaccggaatatttggacctctaatgaacgggacagagtgagccctgcgagaatatcagaaatgtggttctgacagagggatcaaccaggtgtttggccttgagacaacagcgtacggtgagtgaacgaagaatagagcaacggcagtgtggcctgagcagatgggataattggagggttgtaggagagacagtcagaggataggagaggggaaaggtcccggaggatcccagaggataggagtgggccctgtagatcagcctttggactttaacctctatactgagcagtgtgggagcacaatggggggatacgagaagaaaaacgacatcgtgtgacacagcatttgagaggattactctggctacttatgagaaaagaacataagctgagaagggaaaaaataaaaaacctattagaaaatcattgcaaaatgaaaatgagaggtgttgttacttgagagatgacaggagcagaggagatggccagacacatttggactcagaatgctgtttaaagaaggtgctgatggaatttccctacacagtggttgtgacacatgagagacatagaagagtcatggatggcaccgtgtgtcttctcgtgcaacactggaagaatggagttaccgtttattgagatggagaagactgtgagattgcagatttgaaaatggaaagagcaaaagaaccattttagggctagttagtctggattgctatttagacattctatggagttgaaatagggagttggatacataaagctggaattcaggagacattcatggaactgatggacactctgaaaactgtagacatacagatgacatagtcactgaggcctactgaggggaggaaggaggtggtgacggttgaataactacctgccaggtgctgtgatcactacctgggtgtagggatcatgcatacaccacacctcgaaacacaagatttatgcaagtaacaaacctgcatgtgtacccctgaaacaaaaataaaagttaagaataaaacataaaaataaatccacgcgacgcaaactggatgagatcaacaaggcaatgaatgaatgtatttaggaagagaagaggtgaagagaatgaatcttggacaccctaccaaggattggaagatgaaatgaaactggcatgatgactcagaagaactggccaataagattagagaaagcctgaagagtagtatctaaagagacgagtgagtaaaacggcatagaatcatatacagtcagccctgtttactggtgggttctgcatccagtttcaatgaaatgtggatgaaaaatatatatatattttaaatctagaaaatgtttcattgtggctatgtctacaatatagctaggcatatgatggctgcatctgtaccgaccatgtactgactttttttttccttgtcattattacctaaacaatacagtataacagccatttctgtgacatttatatttggtattataaataatggagagatgatttaaagtatatgggaagatgtgtataagttatatgcaaataaaattccattttatataagggacttgagcattgtggatcctggaaccaattcccaatggataccaaagatgactgtgcacatattattccagtgtaatttttatttggttttaatattatactacacttgtataagatgtaaccactgggagaaaatgagaaaaaagtatgctgataactccgtactattttgcaagttcttgtgactttctaattatttcgtagtttaaaaatttaggaagtgtaggaatgaaaagaattcaaggatgaggaaatggatgaatgttaaatgtcactgagatcttgagtgagatgaatcctaggaactgactcttggatttctggctgtggctgacatgtgggccttctgcaggaaacccaggagggtgaaactctgactcaagtgggttcaagagaggatgtaacaaggttaaagaccgcaaatgtggacatctttgagacgtgttgcagtgaaaggaatttcagaaagtaaggctagaggggaatgtggagtctggaagcagacatggaatcaaaagaaaagtctataacattgtttttgaatgggggcaattggagcacggttatatgcagagagcaattctccactaaaaacacaaatagtcgttttgaaagagaagaaaactggtaaagtcgtggcttaaaaacttgatcagagaggaaaggtagaacacaaacaggtgtacccactaggtagaaatatttgcaggaaagatattttataagtaggcatcaaaattgaaggttatagattacataatttatctttcattgcttctattttctttgtgaaatggaaaccaaagtcatcaggtggcagtgaggatttggcaagagatgctggcagctttagaaggaagaaggcatgaaacagtcatcccccagaaagggagcagtgaacagatacagaaagtgaagcgggattgctgggcatcattatgggccaatgtaggattatggccatatatgtaaagttagacctttcagtatgtttttggttttggaattcctccagctgttttacctgcaaggatataaaagtggacttggcctagactggaaccaaaggtgttttactgtgatgatggcagagttatggtaaatgcaaggaagtgcattaggccatgagccctaaggatggtaagacaagagatgaggacatgatagggacaaggaaaagaaagtgaaggggaggcagagtcagggaactctaggtcccatgagtcaaaaaattatgagtttaggtgtttgggtaagtgacctggtatggagagttgggctcagaatgtagtcagactgcagctgtagaaactgatgccttactggtagtgagaagatagagggtgatgatgggaatggtgatggcatggctgaggtagagttgggctgttggaagagaggggagaattaatcaaagaggttatgtttttcccaggattacctgtgttgacattgaaatgaccgagaatttgtgcagaggtagaggtgaagaggctgacagagggcccgaagtttaaatcttcttggaatagtggatttcaagtaggggtttgtagatgactacaaggcagagggtgccagattattatggcaagagactcaaagctgggcacatgagggagggaagaccatgagtcacctggaagtagccatgagatgcatgtgggtgggcacagtctgccagcaggaccagtgtacgtggactacagatgtaaaacattggctactgagatgacttcagagaagacattcaggtttccatcagaggaagaagggaaggaaaatatgtcagaagtagttggaatgtaggaaattctgtttataattgactttcagttttcgaggaagtagtaggagacattcaggagcataggaagaattaagattagggggtcagaaaataagatgtgtagatcttttagaggatgagagttggagggataaagggcgacagaggagaccagggctttttgcagggactgttgtaaaggaagacaaaggatgtacgagagtaccctcttaatggcctcaggcatgaagtaagtggggttgactctctgagaacaggagggagggggatggagcaggaatggtccatgtctctgggttcctttcattctggctcctggaggagtgagcgcctgtggaggtaggtacatcctgaccaccaactctttgtggcccttccttcctcaataatatctcccagtattacaagctattatattacatatgtgggtgtatttcttatttctttcctggatatttccccatgcaattgtaaaaattgagttggaattacacatccaactgtataacctgcatttttaaatttaacatcatgacttagaaattcactgaaggaatattataaatgcttggtaaacacatttgatgaccctatggtttgaatgtatcatagcttatttaatgatgtatccgctgttgaatatttagattatttcaatttttctttatgataaacatggcagtttgcttctaagtaatgttctattctgtattttaaattatgtccgtaagatagatttccagcaagttttatacccacaaaaggggcacaaaaattctagagttgagaaatacacttttttaaaaagtctgaaattacttgggaggaaatagaaatcagttcattctgatttgcacttacatttagaattattttcccaacctacagaaataaatagattcaaatgcatctttccttaaatgccttatgttcttcttggattaagtcagtggtgttcaaccattttttaactgcacaacattttcttcaaatgcagaattttatgataactcaataaaggaaaaatatttttaaaaataattactctgatggaaattcggtatgggcacaaaacctacccactgacgattttgctgtttgtaaacattaactctttggcatggaaatcataggagcacaatttagaaaatactgaatcagactgggcgcggtggctcacgcctgtaatcccagcactttgggaggccgaggcggacggatcaggaggtcaggagatcgagaccatcctggctaacacattgaaatcccgtctctaccaaaaacacaaaaaattagccaggcgtggtgccggatgcctgtattcccagctactcaggaggctgaggcaggagaatgatgtgaacccgggatggggagcttgcagttacctgagatcgcaccactgcactccagcctgggcgacagagcgagaccctgtctcaaaaaaaaaaaaaaaaaaaaaaaaaaaagaaaaaaagaaagaaaatactgaatcatgtgttgtgtgctaactttaacaatcaagtatttatctgtaactttcaacaataacttcaagttttgttctgcatcatgtgtaaacaagggagagctgaaattttaaatagcatttatttaattctgtcaccaaatttcagattccaaataaaaaaaaattatataatacatattagtgtctgaaaactttgatatattttcatgcttattagtatccatggaataaaaggagcttccattatattaatagatcacctaaaaattgaacagaataactatatttgttttaataattacatattttaatacatttcatattttatatgtggtttttaagttaaacttgaacttgatggaacttgaactaatttttccagctgccctgtagcttgctcatatttgtccttttaaaatgttttgctgtgactattttgttttctctacctgccttgactttatttcatgcagctctggtgagtttaaaaacaaagaaaaaacctcctggacttgtggttttcctgcttgctgaaaacaagcaaagcaaaaacacacaaataaacctcttatggattgctacaattatgaatcgttctttttggtaattaatttttatctgaaatttcgctctattaagagttcttgaggcagtttttatagactacttttttttaacactcattcttaagaaagccacagatctctataactaaataaacttttcttcttctattcttagagaggatatggtttgattccgtgcatagccccctaaatatattttgtcatagtcccaacacttgttaaagacaaatgaatagaggcttgtttgcaactgatataactgtaggaaagccagagtcattcaattttcattcattgcatgaaaaaaaaaaagaggaagaaagaatacttctatcaggccgcctcctaggaacaggtgcacgcaagtgcaagaacaggctcataaagcttgcattccattgctttgcactcagcacgcaccgagaggtaagcatacaggatggagaggtgggaagcaatctaggtgagtgctagtttaaatatggtggccagagagggcgggcaggaaagtgccttgtgaggggctctgaagtcagacagggagatgtgcttctcaggcaggtggtcattgcaaaggccttagggcaggaacataggtgccctggccccaggaagcagtgtggctagacccagtgaggaaaagaggaaatgggagccaaaggaggtggaggatgaggaacagaagaagccaacattccagctcacataatgcctttcagggcctggtaagctttggttttattatgagtggtgatttgagtagttcacagctttgaatagaaaatatatagaaggcatgttctatgaaagtgggcatcagtgcttgatttcactgagaaatagtaaaagtcgtggccaggctcggtggctgacacctgtaataccaaaactttgggaggccgaggtggctggatcacgaagtgaggagatcgagaccatcctggctaacacggtgaaaccccgtctctactaaaaatacacacatacacacaaaaattagccgggtgtggtggtgtgtgcctgtagtcccagctactcgtgagtctgaagcaggagaatcgcttgaacccaggaggcggagcttgcagtgagccgagatcacgccactgcactccagcctgggcaacagagtgagtctccatctcaaaaaaaaaaaaaaaaaaaaaataggaaaagtcctggattctctcagcgacaaaagaaatatgaatggtgatataagccgtaataaatagtggtgagttccttctggttccagtctggacttcattttatagaaatcagatattctgacattgccatctgcatgtgcagattaaaaggaaaaggacataaacaagtgctgttccctctcttgcttacctatggatttgacaaggggaaggatcaattataaataaaactaacatcccaagaatattgccattatttatttatttatttattctgaggcaaggcctcactctgtcgctcaggccaagtgcagtggggtgatcttggctcactgcaacctctgcctcccaagttcaagcgattcttcggcctcagcctcccaagaagctggaattacaggcatggaccaccacacccagctattttttgtatttttagtagagacagggtttcaccatgttggccaggctggcctcaaactgctgacctcaggtgatccatccatctcagcctcccaaatgcttttcattttttgtttattccagagtcatgatcctgtgggtgaatgatccttactcctgcgcacaaagtcaatatatttctgtcccggaattctcagcaactgcatgagaatgcacccaaaaatgtcatggggaatttgcagtacataaatcatctgtggttgatatgtgaatatcaagtctcctcggacatggtgctttctgttgcatctgttgggaatgctcttcctccagctcattccttgaatagttcctttttttcaaatctgtcctaaatattgtgttttcagaaaacccttctctgctcattctagtagagaattagttttcgtatgtattgaatgaataaattaattaacataaatgcatggttctgcaaagtcaacttctaagccaattcccagtgattttggcagccagctcctgttcatggggaccagggaattaaaagacagtgcttatgctagcaatccggggtctgttaatgccaagtgcaaatgagattctgacactaattattctgatgttaatgtttgcttgtatacaataactcacttccacatatttagctgaaacaaatcaaatgagggagtcttgaaagttcttctgttgtttgaagtgggaagaaagcaccaaatatagtatccatgggagacaccctatgttctctcaattgagagtgaatttatgactgcaaaccttataataccatgtggaacgtccttacacaataaaagacaattcagaaaataaagaatgagccaattcgttgagaaaggcaagtgtatcgccacatgatttgaaactggagataattcagtgttcatgtcggccaccatgttgagacagtggccctgcaaagcacttgtctgtgtctaattggttgcagagggagtgaccacccggccacgtgtgtctgttcaaggagccggacccgcccctgcattacgttttctgcaagtacaatgaatgtctgtaggcttgaaactttttttattattttattttattttctataagttattggggtgtagatggtgtttggttacataagtaagttcttcagtggtgatttctgagatggtgcacccaccacctgtgcagtatgcactgcatcatatatgttgtcttttatcccctttccccactcccactcttccccccaaatctccaaagtccattatatcattcctattcctttgcatcctcatagcttggctcccacacatcagtgagaacataggatgtttggttttccattcctcagtacttcacttagaataagagtcactagggaggctgaggctggcagatcacgaggtcaggagattgagaccatcctggctaacacggtgaaaccctgtctctactaaaaatacaaaaaattagctgggcatggtggcgggcgcctgtagtcccagctactcgggaggctgaggcaggagaatggcgtgaacccgggaggcggagcttacagtgagccaagatcgcgccactgcactccagcctgggcaacagagtgagacgccatctcaaaaacaaaacaaaacaaaaaaagaataaagaataatagtcaccaatctcatccaggtcaactttgtaacctaaccagctgaatctttttaagaaagtgactatttcatacacaaatttattgaaatctaaaatatattgtagaatagtaaaatgaaggaaagaaggaaaatcccaaataaatatgttttgtttataataccaaattaggttgctaaaaatactacttcatttttatgttttcattgttgctgaatataacacaaaaatccagatatataatagataaattaggccattttattttactataaaatagcctttcctttaaaaaaaaaaaaaagattcatggcagaatttattttaaaacaaaaacaacagcatctctaatatgttttaaatatattgtttgtggatatactctctcagaaacacataaagttctacacgtactatgattaagaattcccaagtttcattcattattcatgaatgttactgggatgttttttagatgttaaactatttcttgacaaaagattgaaggagtttttaaatccctcataacaattatattactataataccacaattatattaaaatgtttatatttcttagtctttatagttaacttgaaatatacatatgtatacagcttaacgtagataaatttgttctgctttttcacagatcagacattatacccttttttctgttttactatagagtatttatggtgattaattttaattttatttagttgatcatatattttctgagtctctgaatgttttccagttgatggtttttttgttttgttctgttttctaaaaaaatgaaaaacatttctcttttggtagctgtgaaagaggaacaaaaacaaacattttatcacacgttttggatgtgattaaatagttcacataatgaccttggtagaatatcagacacgtacaatatactcagtagacatcagaccctaagttgagtaatttgccggcgtatatgagccctctcagtgtcactcgcctgtgttggtaaatcgcctgaagcactgtgttaatgcatgttgatattaggaacatacaactagatcagttttactcttcgtatttatgtattttcagaatttatctttttaatgtatattagaaggcatttcagtgttgttttaatttgaatgcctatcataataagaaagattgaaacttcacctgtgtttgtttttaattttggtttgttctagaattcactcttatttaaattgccatttaaaatctttttttcccatgtatctgtttgtgtcttgttatttacttatctatttatttatttatttatttgtttgtttttttgtttgtttgtttattgagacagtgtcttgctgtgtcgcccaggctggagtgcagtagggcaatctctgctcactgcaagctccacctcccaggttcacaccattctcctgcctcagcctcgcgagtagctgggattacaagtgcccgtcaccacacccagctacttttatgtgtttttagtagagagggggtttcaccatgttagccaggatggtctcgatctcctgacctcgtgatccaccctcctagggctcccaaagtgttgggactacaggcatcagccaccgcgccaagcctgtatcttgtttcttaaaatacaaagcaagtaagtataaataatatccccctgctgtgttgttgcaaatatttttttattgtgttgtttttatttttatacatttattttgaaaaaattaaacaggtagattggtttacttataaagttatttttgcttccgtaacattcacagtttctgtttagttgagataatgcttaatttgagaccatatattatattttaatgtaacaagttacccattatttaatacattcaaacattttaatttgtgtaacaggtattttgtatgagggaatttttaagttgatattttaaaactttctattcagttcttccaatatactttgttaaataatgtctcttcactcatcatttatgatgtacatttaatcatattgggtccttgtagcactccacactgcagggataatggttcccatttctgtcagcaaagcttttatcctttagcgatatgtgggagcaatttaatatctttagcagctaaactggaagataagttcacaagtaaatattatatcaaaaattaagtaattaatttttctcagtcgaaatgggctttgaaaactgtttcctctgtggcattatttataaaattgatcatcctgtagagcttcatagatctaagaggaaacaaactgatttatttttaaaaatgttttgctcatcaaacatattagttaggtagctcttcttcaaatgctattatgtttaaaatgttgctgtttagaaagtaaaatcccttacaaaaatagcggagaaattaagagttaaaaagttttgttagagaagtacttacagcactatagcaggtgctttcaaacacaaacacacacatacacacaaacacacgcacacacatgcacacacactcacacacacacactcacaggcaccaacactaattttgcctcattctgtgctaaagattttctgtgatttaagcattttatcccatgagtaccatgaagtttttttgtttgtcttatatgtgtaatattcaattaatcaatcagactatcttaataatcttctactatattttatgtggagtgctatacaaacaattctaatatatcttgcatatattattttggcctgattctaactgtaactcattccggaatattctatggacattaacatatctactgaagaaatgcaatagtcataaggtttgggaattttttttttcctctgtgctaccttaattgtttttttcttcattttatttgacttttctattttgccttctttatgtcatctactcctttcccaacaaagttacccttaaatttcaccacttgtctgttgcagtcagtgctctggtcttacctggattcagtgagcctagtactcatgctggcccagtgaactatgggtctccatgatccactcattcatcaacggaaattctaggaaaatgtagatagtaagtgtctaagatcttagactcaggggactcaaatattagacaggggcataacattgcagtttatccagctcagccactggcattttaaatagaaggaaactgcatggcagtgaggtatgctcatttgatcagggttggtactcaggggtgggcaccagcacagttctgtcagctgttaaaataaaaaagaaccctcttttaccagttaactcatatccactacccggagccctacaaactccctagacaccttctgcaggtcatcgaaccttccagcagtggagaaaccagggggctaatggctgcagggtgggggccctggactctgtcctggagctatggctggtgtccctgttatgttggctgcctgtaaacactcctgtcagataggtttaaattcacttctggtcaaggttactgagaggttttcccagaagaatcggttaagcttcttattctatacacttgtattctatgtttattctataccatgcacataaatacgactatttcaaagctttttaaataatagaaagtgattcagctcatcgactgccatgacaaaaattcataatcatttgatgtcagttttttttttcctttttttattttcccctctgaaacattgaaaggggggatttcttgccaacaaggtgaattatgaagaatgtatgtagtttcagcagttggatttcaattaatatgtcattaatctttcaactacatcattttggtaacgtggactttgataattttcttttaattccacacatctatgatattttatcttcttaggtaataaaggtattagaactcttttcttctgcatctgtgtttacattgagatgccataacttttgtagtatataatgaattcagagaaaagaataaaatctaaatattaaataaaattatatatttatacatgaaaaacaattattactctggaaatattaatgtgtgtgatatgtttatatagagttatttaatcaataataaaagtaaatatctgtctctagtgatcctgtttacctcatccctttatgaaggagatatttatatttgcgtttaaagaaaaacaacgtagagtatgagtcacttttagttgttaacctgattcaccattatcccaacacaaggggcttagagctgaattctgcccaatatctgaatctcagtagtagccactgtatttttcctcatggctggaatatgttcttcctcttatttttatatggtactgatttttatctctgttcaaaaatacaattttgacagggaactgtatatgtatgatcacattcccagtagctcttcccaagaatgtaataaaaactgtggcgagctgggcagttgtgcagctggttctcagttgaccagggaagtgtgtgtgcttgcacagtggtgtccacggagggcggggggcaggagagacattcggctgttcccaagaatgtaataaaaactgcggcgagctgggcagttgtgcagcttgttctcagttgaccagggaagtgtgtgtgcttgcacagtggtgcccacggagggcggggggcaggacagacatttggtagtgggcacaggaagtacttttgcagttttcaaattgtagtatacacacagttatttttattcgtgtttggttttacacttttaaaaggaaacactaccgtggtagcataatttttataatctgtgcacttaataattattaatcttaaaataaatttgggatctaaaaaatgagtttcctgagatgtcctacaaaacatgggcagccctttccacaacgtcacgtgctttggatgggagtcacagactggctaactattaaaacatgagaacacccatccctcatgtagtcttgatttcgttcatacttgaaggtagtaattttcctccaagtgtacctctcaaagacgtccattctaaagctgccattagcattagttgacataaacagcatgagaatgcctagtgtgtagaccagcctggcatcccgtaggaaggatgggaaatgcaatactccaaactccgggaacaaaaaccgtgtgctgtcaactacccctatgcccctggcattcttctgagtaaactgaaggcagctaatttgaagggacctatatcaccctcttactgttgccgacaagattggttctattttgacgtttttgtgaggcttagatcctgccaaaataaaacgaacatcgctgaaagatgaaagaaatattggaacttgcaacttgggaagagttaataaaaggaggtcatttcctctcacttcggtataattttggtggagagagggtgggtagggtcgaagatatgcactttgtaagagctcaggccggtcacacaacctctgcttacagcaaactccccccatcttggtaacaggctgacttttacatatcatccacattgcagtatcagaattaatgactgttaaatatatattatggataggaagtatttgaggaaagaaagaaaaagaagaaagaaaaggaagaaagaaaggagggaaggaagaaattttaaaaaacatgctttaaaacatgttattttaaaatacttctctctcatatatgtaatttatatatataacatagctatatatagtatataaagtatcatatagtttatatgttatttatatataaactatcatatagtttatgttatttatatataaactaccatatagtttgttatttatatataaactactatatagtttgttatttatatataaactaccatatagattatatgttatatatatcaactatatatagtttaaaatgcatataatattttgtaatagataaaataaatgtaacaaagaagcttttttactctatagcaaacttaccaagatctgtttcctttctaaccaataattttttaattgttagtttctattttaaatgcacttttatctttactggcctttcacttatcacttttctaagatattccattttaagtttcatgtaactgttttctactcagaacctttttatgaggtgatgtgcctcttttatgttactcaatagctatctgaaattcaaaacccaaattaatcccaaatttatggaaaataaatttaagacaaccatttcttttaagagcacagtattctcaaagccaggtatccatgaataaacgcccacatgtttttaagtctcaaaatgttgcttacatagtgtcatcttccaggattcggagaaaatctctgaaaatcttgttaggctgcctatcaatgtcaggtacatggcaactacactttccatgtttcagaaaagccaccgtttccatctttcccgcaatggccattcaattaataagataatttaaatgttagagtcttgtaagccttttcatagaactcattaacataccaaaagattctttttcagattgagtgtctcaattttgggttcagaaaatatttgtcgctgatcaagagtgacacttggtggacacactcgtgtatgaaaaccatcctgaaatgtgatgctttctttctgcttttgcccctgcagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggtaagtcccgggaagagatgccacaaaggatacaggtgtgttttccccgttttttcccccaacgagcttcaagaattgcttgtctctggacgttcatgggcaagcatgtgtgttccttttttcgccttgctcttttggctctggaaaagttacctttactgtgagtaatttcaaagtttctaagatgtctttgtgctggtgtttggagctcgggaagtcatctgtgtgcttgaacttgtagtgctgtcatttttggactgttttaaagcaaccaagtaaggtgagttagttttgggtttggtctgaagctgtttcactgtgagcagagatttttagattgtgtattttcttttatctcacgttagcgagaattgacagactgctgcagatatatgattgtgctttcctttttcttcgtgaagactgtgtaccacattctgtagccacctgtggggaagtgcccgtggctacaagatcctcaaaggcaaaataacttaacacacatcttagtccactatatgtataaaattaaccgcagggtggtcagttctctggtgtgtaccccagtagagacaaaggaaaacaagatctaatgaagtaccgcctatttaggagtgatggtcgtgattgcaagaatagtatcgtttgtgtccataagtgccatttgagagacttaaaaacatagcatagatgtttaaggccttaatttctatcttgaattaagtcatttgttgcatgtaaaattgtgttattgtttttattattttaaacctgaacactttaaaactgcttcagttatctgttttagatcttgaaatatgactaaacaagaatgggtatgttgaaactcaggtagacacagaggaaatgttggccatttatgagtaggaagaggggaatatggaatgagtgattgtgaacatgtcggcaggttgcagtttgcattttagtatgaaggctaccagacaaacatgtcaaacatgaagcatattgtaaatatgagcacctgttttaaaccgattattggaattgaattgagttgcactttgttttccaaatcacaaggctcaatgctgatgattcctattcatggagaagtcctttcctggttgattttattgtgcttgttttaaatgttatttcaaataggagggaggaagaaaccaaacaaattctacctagattgtctttgttttcaatttttttcatgctgaacaacacttttagattagccaggaccaatctgcttaatgtaggttgtatgactttaactttaaacactcaggaatttgtttaaattattacctatctcgctatgtctaacattagagttcatggaagcaaaagctgagccgagaggtggataacctaagttataccacaggttctgccaaaagcaaatccttatgacttcagacaagtcgatttgtaaaaagagaggctgtgctaaaaaaaaaatcttaaaaatgaatttattaagcatctctttagtacatatgctctactaatcatttaaagatattcaagtgatctcacctcttcctagttttaaaattattgtggttttcagaaaataattgaagtataaaatatatagggactcattctcagaagttatatgcttaaagttaaaggtcttatttttaggacagtccagaggtattgggcattgactgcacaccttgctagtaagatgtcaggttgggagagaggtagaagcaagtgaggccgatttgttagtgattctagaacctatgatcagtggcagcttttgccaaagaaacttagtttgtgtcagaaaatacagatcatgagtgtgatgagaagcgtgttctgaaaagttgatgggaccattgtagcactttatggcaacaattgatcatccttgtcatagagagtatcagcacagatagccagagagactaccactgtcttcttggtgcctggatccaggctggaagacatcttctacatcactggaatctctctctgtatttgctagggaagctggtgggaaagttatcagtgggaactatgatcctgtgtgccttcatgtctaataaactctgttgcctgttagcttagctgctctcttcaaatagccatgattagccggggatagagttgtatttatacttgtattcttgggatgacttatattgtcctatttgcttggcgcaaaagccctgtggggtcattattcttactattgtctactattgtctctttattattgtagatttaaaaataaaactgagatatgcagaggacaagagatggcaaagctgatggagcccttggcagagctcaggttcaaggtctctgactccacggcattttcttctctctatgtatagcccctcagtcagtgtagtccaggtctgagcttcaatgccctgtcagagaagtagagtttctctgtttcaggactacaggctggatcataaagccttgaacaggtaactgtcggggtaaagatggaaaagcaatttagcatatgtcgtgggtcaacagagtgttttgtgtgtatgtgtaacatttaatgtttatcataatagtcaaaagaagtatcttaacacagccacaaggactacgtttaagtggaactctcagctttcaatgactcttcagtggaggctgaaaagcaaaagatggttctcctaaataactatggaaacctacaggagcacatttaaaacataaaacagaataatttgaagtacccttttaaggcctatacaaatgcataatatgatttatcttaaaaagcctattattttacagtaattctacagtgacagtctctgaaatatttcatgaatcaaattggtgtatttaaaaggtttccccattcccgaattgcatagacagggacggggagcattgtgggtgctgcgacctcttcccaagcacagggtcattccacagagccaggagggtggtgcgagtgactgtgagtggagtgagggcagatacacatatgatcttccaataatctatttttaaaaaagggcatataagcaagggcactctcagaagaagctacttggaaaattgttaggaacaataataggattagccttattttcatttaatttggagtgaaattacccactgagctatgttttaagtcagggttgccatggcagcagtggaggcagtctaaatataggggatgatgtcatgtgccaaaattatctttatattaaacatacgttgggttcgtaatttaagcctcataggctataggtacattagttgaaactgacttttttttttaactagtcggattctaatttcatgcaggttggcttcctatcaatcccttgctttaacagagagttgccattttgagttcactttatagcatggtctagtcattatttttcttgcaattaggaaggatttgtgtagtggtgagactagccaagtgttctttttttttttttttttttctgaagagatttgatggtgtagcctataacttgtacttctaataatatcaagaagaaagaaaattgatttcatttctgagttctccctctatggtttctaaattaagacatgatggttaacgggattaaggttgtatagtcttggctgggaacactgagggagcatttactccctttaaaatatgaacttatataacaaaagaaacaggcttccatacccttctgtgacagggaatgtgtagaggatagagaaggtaaggaaaaagaaaataaaaataaatgcattgaaaatgtgtcccaaaacaaatataaatgcatcgattcttaacttccatgactgagcttcagctccctgagacagagcctggaagcctcagtgtgccttcccaagctgtccacagctaccgatttggccccatcctggctccctccctgccaggcacgcccatccccttgcagtttgcccctgtgaacccatccctgtctttatgttactgggcgttttcatccctggtgcatttgttcagctgcacgtttccacgtggaaatcgcccactgcctatcttttgtcgatcccattatcataatgcttagaggggcatgcagagtacctggaagaacactacataaataatgcaagtgaaacaaacaggttgtgtgatctccctccctggaaaacatcagccataataaatgcaagaacatttcttccgctttggattagggctgccttatgacttcaaaagaaacatctgttactttatgattttttaaggtgtaagctctatttttcatgaaccagcataacttgacccttttgcctatctggtgtatggaagtttacaagggaaactctggggtgacagttttgtaaccttagtttattttgttcctgttaaaccagcacaattttactattaagtcaatctaattggtgactggctaaagttaaaacaaaacttcagagaaatggggaaagctgagtgaatttcaaagaacgcttgaatgggtcagttaatgcttccagtgtttacccaacttgtcacttaattgataattgacttggtgtctatttaatttctaaccagggagaattatagaggaacatgctgagtaacagactccctgaaatcaatccttctctcacgtgccccaaaattaaaggaaggaggcatcatgttctccctcctcatgttgttattattttgaattcattttacagaaaatttgcagcactaacacagagagttgctgtatatcctaaacctagcttccttcatgtgaacatcttacataaccatagtgtaattattggcaccaagaaattcatgtagcatcagtgctgctaactcattttcagactctgtttgatttcctctgccttttctactgatgtcttttctggtccagggctccagccagggacccacagagcatttggttttgcctccttggccctgtccaactgtggccgtttccatctttctttgtttctatgaacttgacctatcccatgttaacaattcaatcttttgtgagaaaaatggctttggaaaagcagtgacatcgtttatgaatatggaggagaccacgcagcaatgctgcagtgccaccaattaaaatgggcgaattgttttttgtgctttcctttataattttttaatgttagtactgggtctccttctgtcacccagtgtggagtacagtggtgctgtcatagctcactgtagcctcaaactcctggactgaagccatccttccaccttagcattccttgtatctgggactacaggtgcagaaccctggctaatttttaaaacattttttgtagacacacggacgtactgtgttgcccaagctggtctcaaaatcctggactcaaggaattctgctggctcagcctcccaaagtgtggaattacaggcatgagccacaacagccagtcccatattttctatcttaaatttggattcagtaattttatttcacaaacctgttgtaagctatgcacctcaacacttatttttgttttaacttcagccaatcactgattagattgatttaatagtaaacttgtgctggtttaacgggaacaaaataagattacaaaactgtcaccccagagttccccttgtaaacttgcgtactccaggtaggcaaaagggtcaagttatgctggttcatgaaaaatagagcttagaagtgttgttttttagaagtgtttagtatagcataaatgggaaataaatatgaatgtaaatatatttatatatatctaacaataaaaatatatataatatatgtacatacacacacacacacatatatatacacatttctccttttcttgatactctgcataccagctgaaggtgtagggatataattaacatgatattgtagctctattcataaacccctgctttaattaaaatgccatttctatgttttttcaatagtgtattttttttgtaaaaaaacatttaataatcaccgagtgtttgttatataacaagaaaatataaacaatagttgctactgctacttggagatactactattcccattttatagatgagaaaaataggcttcaaagtagttaaatattcaaccatccaaaaagcaaagaggcagtgtggagacttgaagagagacagtcccaaggtatatttcctcctccttttaaaaaagttgagaccacatttcatcgctaatttcaaaacaggaagatggaagcagtgtgtcggcactccactctcatcctagaatttcttcagcaaccttctgccttagtgcatacaaagaaagtgccctccacttctaatttgtagtcatctctgttactgtgtggtggagtcatcactagctactcttacgtgtttctttccagcattattcactagacagtaatgtaatcatcttagcatacttgcttgttgagcatatttctgggtataacataatgatagatattatcaggcttctaagaggacacatgaatgacaagctgatgttaccatgaagctgtcgcataaagatgtgactaaacagggttatatatgcaaccgtgacgcactgaagtcttaggtaggtggagaaaactggccatcccagactacgccacaacctaggtacctccaccctgaaactcaataggcaaataatgcgaacttctttcaataccagctaattctactgtacggataatttctaacttgattggtggctttctttcacatgccttatcctggatatttttgttttcacctgggtggattaggcaccctctccacaatgtctactgtggggccaatttccagtctctaccttttctctcggctcgtggccagggatgaagccgctgggcagcgaaggaatttctgggaaagatgctgcagccccacaagtggagtgaagcaggcaggctgtgttttagaggtttttgtcaggtgtgtttttgcaagacacattttctctcctgtccttctgaaaagcatcatctagagatgatgctttcaccaggcagtgaaggaagggtctttcacgtcagaatggacctccaggagcaaagaaggtggctctctgtgaaggggcagctgcactctctgattcactaccaggagcgtataccctaggaattatttcctgccctcccctctccttcctcatgaaagggatggactcaccagcaggtgcccctgcaactctgagaagccatcgactgtcttattgcctagaattaagcctgaatttgagatttcttcacaaattctagaaatagcattctagagcaatcctttaattcgggttaagtaaataccagagtttcaataaagttaaaaaactatttcaaagaatacgtatttgaaatttgggacacttttctaatttattgaatggtggtagctatggataaaatgtagtattttaccctaagattccataaaattgtccagactgaggagtaacagagaagaagaaaacatccctggtctctaaagatgggaccaataggaaaaatagttatcccgggagagaagtccccgtctccatccttaccattcttagggcagagttgaactctacagttctggtgtaatatttctctcatgtcagatttctccaaattaacctcattttattgaaaaatacttttcctataaattatttaagctgtaggcaatgaaaaaagaagtcttttatggattaaaatgtatttcatcaactatgaaatacctgttgtttgtaatcacacttctttctttttgtatgtggcccttaatcctggaaacaataaaaaagtaaaactaaattaacgctgttaaataaatttctcatttaaaaacactctgccttctgaggggccattgcgcccactccattttagtcattctcaaataatgctgcttaactctcatttattcctcaaatcagccaactggcacatcctcgtgttccaattgtacattttgatatcttcatttagagtttctcttgaagccatgaatatctaatttttctctttcttatgaaagtttgcacaatttcatggaggactggttaggagaataaggtaattttgtgcaatcctatactcctccaaaaaatgtgacattttgttgcttgggttacttcctgttggcacgtgctatccaagcttaatacatcctttaaatgagtagtggcctagaacattagcgtttcccacctatgactttagtaaatacaagtatctaagttcttctgattcgaatctctttagagtatcacagtatcgtttcttaataaacatatacatcataaagactttaattttttttgaattataaatttaaaatagatggcacctgagaaatctcttaatgcaatccctttcttgtttggggaaaaaggaactgcatcataaatagatcatgtgctttatcctaccctgtggagtattattagttggctagaagagaatccaggttttttgtctgtgttaccacaactcgttccagcatgctaagaagccgctcttacctagcttggagagtgttgggcaatgtcctctgtcgttttttcattacctttctatcagcaggccataaaagcatagttgctaagccaagatgactgattcagacctcggtttgagtgagacttaggctgtagtcttggttttatgacttctgagcttgatgacgtagagcaggtttgctctggaagtcccagatcactgtctgtaaaatagaagtgattgccacatccctgagagagctgctaactagagcaaatgagcagacgcttggaaaacccttagcaaaatgcccgccccacatagcaatttctataactagctgcacgtttactgctgtaagaaacagtgccatagagagttcagatttctgccctacaatgaaaaagaaaaactttttgaaatagaatgtgttttgaacaatggtttttacctgtatctagttctaaaagtctatgttcagcaaataaccttcaaattttttgagttataaaagctgttaacttctccactcaacttttaaaacattgatcttactttggttatgaattgtgtgacaataacaacagtaataatatcactttaaaggaaaaaataggacctaaatgatgacccttccttgttgtttggaaatataattgaccataatcagcattgtttcacattcagggctgtttttgtatatgtccgtcaactttgtgaatgaaaatcaaaatgctatcctggtttagatcctgtatatcacttagtaaaaatgaaatgtgataacagtggaattttgaccgaagtacatatttatctattaaacgttcctctccagctgtcatgtgcacaggactcactggagatcttttcaaaatgcagaccgtgatctagcagttctggagtgagtccagagattctctgtttctgacaatcgttcagctctggttggtgctgctgttccgtgctccagagcctgagctgtgagaggttagggtgtttgtgagtggcgtacatatttgacaaacacagacctaaaaccataactaattatcattcataataatttcaggttttcctccaaactgaaaaacattgcagtagttatgctatttcagaatttgatgcaagctcttttgtctctgttgaaatcctgtgtgatgtttataatggccttctgggacaagatggagatgatccagaaagccgaggttcaatattgagtttcagatttaggattcacagactcaccagggtcttactgcttagagactctgatttagttttctgaaccagcccaactgcccagcagatgactatgaataagaggtgacatcaaaagggtataaaaaaatcacaatatttcaacagcttccctatgtttttaggcacagtagtgtttccaaatctattaatagctgtgtgttgaaagtaaaatcattttgagctcttttcaagaaaattgagttaaaaagttgagcagtttcctttgttgtggatttctcagtcctttgatgtgagaccattcggtgtgactctcagagatcaggtagaagatgttgcaatgtgccaaacagattggaccctgaaccatttctttttggcaggctgtcaattaacatctggaactatgggtttggataaggctatgcttcttgacgtggcgcagagcctgctttggcctgagtcctgtcaatatttacattccattttgcactttatgctgctagtgacctcgttccaccttgcagtttcctgttttcaatccattttctctgtctgggaactgtctcttctgctttatcagcaaagccctactcatccttcacagttctcagaattggccttagagtgagaagaacgaggaattaaaaatggtgttcctccccttcgtagctgcaccatttgggctagagtcagactcccagatttttggtttcctgactttaaaaaggagattaaagatactcatctagctgggtgaatatgaaagtaaaagtcagaaacctaccactgtaccaggaacggagacagacaacccctgtatccattagtcgttatcatggcatatgtgataaacaacaaataagcaatgcagttgcaaagatgctgtcggtacttggaggagaaagaaagcactgctcagtgaggtcatcacagaacatgttacagaaacactgggctgtgtgtagcctttgagcatgggaagcatgttcacaggaagagtgcgtgctgctgttgtgggcacggtgtgtgtaaagtaagaagtgtatatactggattgctttctcccatagaactcggatagacgctgtgtgtgtaaatacattccagtaagttgggagaaaggaacccatcgttttcacaaaatgatagaaatcactttaacattttggatggatgcggtgattcacgtctgtaatcccagcactttgggaggctgaggcaggtggattatttgatgtcagtagttcaagaacagcctgaactgcatggtgaaacgccctgtatactaaaaatacaaaaattagctgggcatggtggcgtgcacctgcaatcccagctacttgggaggctgaagcaggagaattgcttgaacctgggagcagagattgcagtgagccgagatcgcatcactgcattccagcctgggcaacagggtgagactccatctaaaaaaaaagaaaaatcacttaaacattgtaaaagcaggcctttgagcaaaactgaaacatgataaattttccatggtaaaatgcttgtaaaatgttcactctgtccctcatatctcatggtataaggaaagcagtactttaggaaaatcatgatttaggtatgttgcatggcttgggaaaaaataaataattagaaagttgaaagattaagatacttataatttatacgggtctgctgatcatgggagtagaaaaagaaaggagaaggatcttgcttttggtagccagggaagtcagttgctcggctttgcacatggctataccctgatatttcagatttcaccttgaagtggaaacgtattcaacagtgaaatgtccagggcctgtggttaggaaggttggctgggggtgtctcagtgctcagggatctacatttcaatgaacaccctagaagggttttcactgagcttttagaaacatagggaaggattgtagagagaatgttgatgccctcagccaggcgagggaagttataaagctcttcctccatctggtgtctttgcaccatctcaggaccgaggggcagcttaaaataaaagggctctttggagagactttaaggtgatgccttcaagtcacttgagaaatcctgttcatctgaacttgtagctcccagatacgaacgagatccttgatttttggatggggtcttcatataatgaagaggaaaagacagggctttgagatagcaaagagaagcaggggagtgggtggggcctggcttaaatgggagtcagaggacagccagggaaacttttaggctagaattagaaaaaaaaattgagttatgcaaaatggtttgaaatgttcaaagtaagagtgcacgatgaattgggaagaaaaattatctgatgctcagacagacctagggtacagtctcagcattgaagaatgctgtctcaccctgtccaatctgggcgacagggtgagactccatctcaaaaaaaaaaaaaaaaatcactttaacattttaaaggcagcctttttaatctaacttcttgaatcaagttgttacttgattcttggaggttgtaatgagaattctagcatcaacctagcaagcttctgtgagtgcaacggttctgccgtgcaaggatcttcctgtactagaaggtggcgccccttcaaataaagtgaaactgttattattccatagtagagcaatccatggagtaaaatgatgtgttcgttgtatctggctcttgaaacatttgggatggagacttctgagcagcaattatgttctaaaatgtgtgagtgtgcacgcccaggtgtgtttgtgtgtgtgtgcacataagactagacaagagggtagatgtatattcatttactttctatggaagaaaggaaaacaaaacaatgcaatctgtaaccctaataaacgaaaacatatatgcctgctttaaaaataatttattatctgcaaatgtgctttgtgcatggtgtgggaaatttgtaaagcatgaaatgggacttcaatttataacccgtcaatgcttctcagataccttctagtttaccacaaactgtgagaagggacaaggaaggctcagctggcatccatcacaccctctcctgaagtacatgatctatggtgtaattcttcatgacaagtcccccctaagtaacataaaagccacagtgtttttgaaagctaagaacatgagcacagtaatcaaaatgtggtcagagccaccttatgagatccgtgattttcccagtatcggaataatccatctttcccaagtcttcaccaaattctaaagtgttaattttaaaggcttataatgaactacaatgaagcttgaaataaagtattcgttttatggacatagattcaaactttctcttcatttctggctttcttcttgctcctttttctcttccattccctctagttttttgtgtgtgtgatctccctttacacccacacacacacacacacgcacaaatacatacaaatatatatatatatatatatatatatatatatatatatatatatatatgatatatacactgaatcctgaacccataaatcattctgttttcataaaacacaagtaacaagccttggcattttgttcaaatgaaacccctagctgtattttttcttacttgaagaatccaaatattgtacttggctatatatatattttttaatatacctagacgaaaaatcaaaatagtgtacttattactgctggattcaaaatgagctagtcattatttaatgctgctttaccttatagaaacatatatcaatgtgcctctctgtttaggtttgttatcttagaaccaaaagtactcaccagtttagaattgaaaagtctaaataggaaaacagagactcatgatctgtcgtcagcattttcttttggcagtggatcgaaatttggctcagtaaactctgtgcatgtgtgacattttattggggacatcaatgtgacatttgaagttaagcttgccactcgctttgcaggatggcttcactgtgcaggtggctgggtgcaagcgcagtctgagaggttcctgacctgaattttctgcgatgtgctctagagctgcaattgacagccccatcagatctgctgtgtgctctagagttgctattgacagccctgttagatctgtggtgtgctctagagctgcaattgacagccccatcagatctgccgtgtgctctagagctgcaattgacagccccatcagatctgccctgtgctctagagctgcaattgacagccccatcagatctgcaatgtgctctagagttgcaattgacagccctgtcagatgtgcggtgtgctctagaactgcaattgacagtcccattagatctgctgtgtgctctagagttgcaattgacagccggccagatctgccaggtgctctggagctgcatttgacagccccatcagaactgcgacgtgctctagaggtgcagttgacagccccatcagatgctaccagactaggggaacatctaaccatacttagcaatggcccccaatccatgggattagaacttgtcctgaaaatacactccacatgatctctatcatgatacacgtgggctatggtttgaaaaatacagtttgataaatggggtttatgaaaaaataaaatagaaacatcaaaaacaaaattggggctgtccttctccacggcactgaaatggcatccaagggcagtttcctgtcccaagtcctgtaagtatattttcctcatgacttgatatctaccctggtgacttataggtaattttagatgtgggaggctgcggccgggcgcggtggctcacgcctgtaatcccagcaatttgggagggcaagaaagagggatcacgaggtcaggagatggagaccatcctggccaacacggtgaaaccccatctctactaaaaatacaaaaaattagccgggcgtggtggtgggcgcctgtagtcccagctactcgggaggctgaggcaggagaatggcgtgaacccgggaggtggagcttgcagtgagctgagatcgcgccactgcactccagcctgggtgacagagcgagagtccgtctcaaaaaaaaaaaaagaaagaaagatgtgggaggatgcataacgatgtctgaggcgttttacatcattagaggctcctggggaaaagagtcagccaacttggattgggatcccggccccatgatttatcccgctgtgctgtcttgggctactaactagctctaggggccctatttgtcgtttgtttgtttgtttgttttgtttttcatctgcaaagtgcatataacaatatctatttttcaaagttattgtaaaggcaagggtaggaaacgctaatggtttagctttgtccttggtatgcgtagagctgcaatgatgaaagtgaccatcgtgctcccctcagaatcctccagcggattcttgccctcgttctggccctgtccattatctgtgggcagctccttccacgttaagcctcctacagatgccgggtgcttccctctgcctcctgatcttatgaggcttccggtccgccaccctggtctcagatctgccctatctttgccccacataatttaatggctttttttttttctctctcagcagtacttcataatagtagtgaaattctaaatgactaggcgcataattctagtgcacataatcctagtgcacataattctaaatggtatgcacataatttatgatgcgttatttttctggtccttatggagtatatactaatagtaatcatgtgagttaagatctttctattaattccatgtcttattgtgctttccatatattagctcatttaattttcctaacaaccatggaggtttgtacaaggattatcctcattttgcaggtgagaatattgaggcagagaaggattgtgtaatttatgctgtatcacacaactcaggaatgtagaccaggatttaaatcccagcattcttaagttttagctcagattgtagttaattctaactagtttattattattattttttttattaatattattattattattattattattattatttttgagatagagcctcgctgtgtcacccaggctggagtgcagttgtgcaatctcgactcactgcaacctccacctcccaggttcaccccattctcctgcgtagctgggattacaggcgaccgtcaccgcgccaggctaattttttgtatttttagtagagacggggtttcaccgtgttagccaggatggtctcaatctcctgaacttgtgatccacctgcctcggcctcccaaagtgccgggattacaggcaattgtaactagttctgtatgacaggaaacttcacagataaagctgcattactccctgcagcaagtgcacgccctcctgctgactcactgaaaagtgaggctctgctaactgcctcttctcttgactttgtgaagcgcacagcctgtcggacggcagggtctccaagcacgtttattaaatgtaggactgaagaaatcaaatacaaaagagcctttctttggggcacaattaacgtcaaagaaggaaactatgacaagagacataattaaaagacaactcaaagggaacaatactgctctaattgatacaatttaaaggaaaaattatgagtgatgtgatggaacacggtgtggaaagacttaggtaaacacaattgtatgttctttttttttttttttttttttttttacttttttctataagttattggagtacaggtggtatttggatacatgagtaagttctttagcggtgatttgtgagatcctggtgcacccatcacctaagcagtatacactgcaccatatttgttgtcttttatccttcaccccccttccactcttcccctgaagtccccaaaatccgctgttatcattcttttgcctttgtgtcctcatagcttagctcccacatatcagtgagtacatacgatgtttggttttcaacgcctgagttacttcacttagaataattgcatgttctttactgaagaaaactatggagatacccattcttggagtctcttgtacatgcagcgtaactatcactgttttccatctggaggactcctgacatttcagcatgcattatgcaaatagcaagtccttggaaggaactacaagtacgggcgtttttgactgtgggaaaattcatggttactacaggatagttgaaccttgaagaacctctgggtgtgggtacaaaggtggggaaaggtgagcagggcccctactctttatgggaaaaccactgggaacggcgggatgttttagaacaattgtgaattttagcctgaaaataaaaacagtctccaccttcattcccaacttgaaaggattttcaaagtagccaactgctgggagtggggacattagtggttggccaaggggtatgtatccccagtctaagtgagaatgtcgcctgcagcagaaatgaaaattcaggaattcagaagggtgggggcttcttacttcttgtcacatcgttcttttaaattctccagattctcaataggcagaaacccttgtatattttcatttgatacagaaaagccataagcaaaaagtaaggcatcattggggcataaaaaacaaattaacaaggggggaaactattttcactacgaatttgagtggaaaaccaaagagagacgacaaatctaaatggcataaacaacatagaagcagagacgagcagagtgaattgtgaggaagtttggcaaaaaaaaatcttcacaaacgtgtaagatgtgaagatttccctgaccatagaagtgggaagaatattttatgccgccaggaataggtcaacacttaaaataccgcgttaaagctgaaattcaggattatctcagaactgcttccggacgcatattacagtgtgacaagaatagcattgggctgtggtcggatacaatgctagttcagcttttcccctaatagttaagttcccatctatgccaatggttgataagatgaggcatagctaattttgattgtgaaaagtgataacattgtgtcatatattataaaatgctctataaaccgtacagcactatacaatgataaaacctattttctagaaaaaacagacaaaagtaatcaattaggaatagaagatgttacttgtgtgagtctgtcatttaaaataattgaaccattgccatgtgaatacacagtttgaagtatctgtgagttgttcaacccagttcttaatatttaactttggcagtgttggctgaagctatagttcatattattgaggacaaagggtctttatggagtatgcctttcagtttacaaagtttatttgtgactgtctacagtataaatagctctgaaaatttagacacttctctacattttcttcatgggtttgtattgtcataacaagataccacagacggtggcttaaataacacacacttatttctcacagttctgaggctagaagtttaggatcaaggttccagcttattcagttctgggtacgcattgcgtcctggctcatagatggcacctgctttcagcgtcttcacaaggcggggagagagctctggaatctcttcctctttttataatctcatcatgttggccgcatcctcatgatcccatcttcctgtaggtgttttccaaaggcctgagctcttaatatcatgacttggagagttacagcttctgtatatgaattttggagtgacacaacattctaagccaaagacacactgtatcctgtgagttgcatgcacatttatcaacgccttctcctgcagcttttccatgtagcctctgtagctgcgctgatgtctcctccagctgtccttagtcattctctcatgccttagaacagccatcacaacagcgtgatacctgattcacacctctgttactacatccagaacaaattagagcacattgcaatccgctcccaaaacaaaaagatgccctaaatttcctggcctaaaacttcctatacattattgagatttggctgtccctgtctgttagtgtgctaagatctcacaggtgttgtaaaatgtgatcagggcctgaggccccatgtttcactgtgaagtagagctctctaaatgcactggctactgttcaaaggtcgctgtgcacatctgaaggaaaggaggaaacttcttgtggtccaggtgttgtgcagcatctttgttctttttctgattttccaattgttgtaaaatgcaagcttctaggaggcagtgtaaaaacagtggaacctgtggctggcaatgaaatgcacattaggacgctaattccttgtcttctcactgttcccatattgtgttcctttcattaaacctaatgggagcgctgggaagggatcaagaggagacgagacctcagtaaatcaccgatgtctccggaaaggaaagctgctttcccttaaaagcatgagcaccgtcatgcactgatgtcgtatgctggggatatgtctttttacatcaatatcagagtgctcaattagtgataagtagagccgggttgggcaggagtaatttcatcatcaccacgaggaggtggagagacagcagcgacgagacgtttccttccaattatttacccccaacatgcctcaatctattcattagaccctatgaggatctatatttttgaaaccctttgccaaactcacataagtgtgtttcaggctgcgtggtagaatgtattgaagtaaagtccccatattcatggatttcttacaataatgcctgtattggtaggtaggttccaagagtatgaatagaaaaaaaatatgagtggaagaaatctatgaattatgaatatttgataaataagatgtaaaaattatatgtgcttaccaaaaaggaaaaaagagagccatgtgggaacagttgtttttgtggggtttgtgtggttacaggggtgactgaggctcccatgtcaggtcacctctgctggaggctgccaggcgctgggaatcctagcacacagcagtgacctcattggtaataacaggagtcctgcagacaggctgtttcctcactcgagaggaagtttctcttgagggcagggcttgcttttcgttttgttatccccatgagactttctcacagacaccgagtttcacagttgctccagtacaacgtgctttttgaggaagctatgagatggacaagcaagtgtccatctgagtaagagctatgagatgctctcatggtaagagctagtagatggacacgtaaaaggcagccgtgcacatgacctctccatggcacgatgtggctgacatgaaattggaggtcagttaccattcttgagtttattaaatttattctcagcctattttccttagttatttcttgtgacttgctgaaaacctacagaatcatataaggaaataggtaatgaaagcctggaggagcaaattaactaagcatacatgcagattcacaaaattgtgaagaccaaaattaatatttcatttccaggcatctatgacagaaagagaaagttggtgatttaccacattcttatgagcagaaaggagaaggttccagatttctctcaagagtggcaatgctcttcttagcactcactttgaaaataaaatttaacatggggctttgtgccagagtcacaaagtattaaaaatgtttgctgctctgaacagcagaatccaaaactgtcaaagcaaattacctgtgagttttccttaattttttttttctttaagtcgcaccaatgccatccaaaacaactcagagaacatggaaaaaacaggaacaacaacaaaaacaaaacctttagaaatttctcttttcagcaaaatgtattgagtgccttctacttgacattgctttgctgagtatggcaggacattgggaaaggaatgaaatgggatctgtcttcagggaacccacaatctccttggatcatagtgtgggaaattatcataggtggaatgtagcaaggagtgtcagaaatagagcacgtgttcactgattgtgatcccagggaaatggaaagattgcttcagcccaagagattgagaaaatgttcatcatgaaagtttcatctgaggattttataatgcagaaattaagatgaaaggaaagaagcaaaaatctaaatggaaaaagaaattcaagaaaagatggttgtaatcccgtctcacccattccctgcaggcaccttcacgcccccacccactgcacactaatacctatgtgttctgtgacatgtgtactatgccctgtgacaaatctgtactagacactatgtaaatggctaacaagtcatttgcaaacaaattcaaggtacacatctcagtgctagtgctggtcagtgcagtggttgaggtcagtgcagtggttgaggtcacagatgctattctacaggcatgcgaccttgagcagcattcagcctgaagaatttcattctctacaaaatgttgagagtaatggggcccacttcatagggttcttgtggagattaaaagggttcataagtaaaatatcttagaatagggaatgcgcaagaaagctgtcagtcacattgatcagggtggtcatagggttgcattgatgaaataattaatgcttatgcaaatcttgcctggttttactttgtcttaattgctgagaagacactctgtttcacaggctcttgtgatattatatttgactattcaacaaatatttattaagcgttatgtgttagtcacacttctagacccgggagacagctgaattaataaacaaaaggaaactgctttccttgatgaagctcatgctagtagaagaagcagcaacttgaagaaagttcaggaatcttcatcaacgtcatgatagttacctttcagttttagtaattaaaaacgcattgactctatgagaaaaaaatgataagtataacctgacagctaaaaataattaagaagttacatttttaaataatttttaaaatggtatttaaagtatttttgaaaccagtacatatgtcattttaaaataagcataagttatctcgtatttgaaaccttaggttatgcattcttggtgtagaatttctactatataggtaatgtattttctctattagattcttacaagttcgtgacccccccaaaaaaatttaacatatcaaatacagatttcaatcagtatatattgaatatattgatcttttcaggatcataatattttaaatgttaaaaactgatagattaaaaactgattttaatgttaaaaactgatagataaaacatactgcaaataacttttatgaaactaatacattcactcatttgcaactaatgaaaacataatatttgtggaaaaatgaaggacaacaataactaaaaattttatatgaagaatgtatttgaataaaaataaacctatatgggttttttaagttatcagagaaatcttttgaagacttggacatgacattttctgttttattttaaagtttgcatgtaatgaagtcgttgtcaaccatggcttttaaatccatcatctcctgtacatttcctgaatcgggaccattaagcactgctgggcacctacaggcactttagtcatgggaaccctttttctaatccacacgaggtgcccagcttctctctgataaagcgctgcccgtcatcccgacagtgggagaagccatggcagcagcaacctgtggatgaagtttctgtgctacttgatggagacagtgtcactccactgtgatgtattagtgcattttctaattgaatttttctaagggttgtaaatggttatcatctagtattaaaaataatgctcactgtagctcatatcataaaaagaaacataacattattatattgcagttcatgtccacaaacatccaaactgttctaagggcattttgtgtaaaaaaggtataaaataaaatagcaacaaccccaagctctcatactgataaataacgaagcaagtaatggcataaaccaagtaatcaattatgtaacaataacatcgtaacaggatgctgaatgaaaatcatactgtaagatgaggcatgcctctcgtttgcattccatggaaacatgcatagtggttttcaagttattaaaactagtttttaacgttaagaaataaacttcagtgtacagatgtatattagcaaataagatttaaaatactttaaaatttatattccattttcactgcaaagaactcaagcattccacatagggaaaatcctggattcttaacaggtgttagttttgatttgttcgaagtaatcaagataattttattgtagtagataaaaatatatgttatttttaaattcttaaattatgataacacctgattttatatcttactctggtaaaacattaattgcatcattggagatgctttataaaaaattgtgaattaatgattgaattaccaataactgtaaagaattccgtaagtataccaaaatttagttttgcctgttctgttcttcatcttatataaaattttcattctgttatgtaaaaaaaaaaagagctgcacgctgtttttaaagcagtttaaacagttctttcatctaataattactgaatgtttagtaaaaacaagggttgttattagaaaaaggattgccactagttctgaaagcaaacatttaaatattttgagacaactaaacaactactatgaaagattttatttttaaaaataaatactttttttctgttttaatacattttaataagtagccatatactattatttgcacatacccttatgaatatcctggtcgaagtgaaaataaaaatacatgtttaatttcctccttcttttaaaagctgtatatttgattccatttctttcaactactcaaacagtgcttaaggggcaaaaggaataaaaaatcaaaaaagaatactagatttataatttaaaaatcaaagaaaaataattatttaagataattatattatttaaaaataactcttatgaaaggtttcctggctttgatctttcagctaataaactgtgggggtgtgtgcgagtgcctctgtacatgtagacacacacacacaaaactacctattatgtgggtacaaaaagtaattagaaataataaataagacctaccatttcagagcacaacgaggagactatagtcaatgataacttcactctacattttaaagtaacttaaagagtgtaattgcattgtttgcaactcaatggataaatgcttgagggaatggatatcccatttttcatgatgtgcatgtttcacatggcattcctgtatcaaaacatttcatgtaacccatcaatatattcatctaccatagttacccataaacacttaaaattaaaaaacagcaactacatattaaacacataaaaggccagggctggtttctgagaaatagatactgtgtctcaaataatgaaacactggttggtttgcattagtgtatcaatgaaatagccactgttcttgcaaagtgataaaggtcttgcattcacacctctgttgccagtaccaaggatactgtgaggtacttgagggagtaaacagatgacaatcaggaagcatcacaatgatgaaattgtttctctttcccttttttccttcttttttaaaattctagaatgacaagaaagaattttgttgtttgtagaagtacgtttgttcttataccagaatgatttgttgggatgtatgctattttttaaaataaacaacttcagaaatattgcaacatattttcaaaaaatttttataatttgcataaacttcactagtagggtgtgacaggtgacaacagtaggtgaatacatgaaagttaaatattcttttgaaaatcttctatctagcaccaagcagagtgcagacattcaactgatattcaaatccctcggcaggtgggagaaccctaaagaggctcatgaccaagccatagctctcactcccacctgccagggaacagctctatgtagggcacagctgcatgcagcaccaccatttaaggtaacagtttttccacgttttcagacaaaacatggattcgttagaattttattttcataactttccaactgtcaagaaagcaggcttgcaaaaattaggtattctgtaaaacaaacatttgttatcaaagcacacttatctgtgatcttattggtaaacactgttagaagagaaaaataaatgtaaaatttaagcagtaaatgtttttccacataagtattgtgagtaatttttatttcattttatttccttcatttcctactttgcccatttaggttgttttccatttttacattttgatggtttttattttttccgtttgctcttttataagattctgaggtaaatgtcaaagatatgtgtgaatatccaaaattattcccataaaatagattcctaaaatgtgctagatcattgaatatatacatttttaatgcttttagctggtgctgtgtgtttactcccacaagtagtgttgaaaagaagctatttgcaatatccatgctaacactggtcataatctgttactattcttactatcacatgtaaactaacttaagcaaatggcttagtagtacattaaaaataaaggccgttttataaagatgaatagcataagaggccctgtgagcaatatgtggtcacacgtgcttattcagagaaccatattcctaaagaatgacagaggcaaaaattcattccaatgagaaaggaatgaaagaagccaaggaatcactgtttacaaagacctaaagttacattaaatgttaatcacttgactttctaatatacttgtgtttgtataaagaaaaaagagctttagcaaaaattaaatgatattttgagaaaaagtgacaatcttggaaaactggatttctaacattgtgttggtaccttatgtatctagtacttataaaaatgaacacaaggtcaatactatttaattgaagttcttttttttttctccctgctttcttcaacaaagtgataggaaatcacatctatggtcttagaagggccaggcacaggggttcaacctgtcatcccagcactttcgccgtcccaggcaggaggatctcttgagcccaggaagtcaggatcagcctgggcaacatacagagcccctgtctctatgaaaaatttacaaattacttaggaggttgatgcaggaggattacttgagcctgggaggtcaaggctgcagtgagccaggatcacccactgcactccagcctgggcaacagaatgacaccctgtctcaaaaaaatagacaaacaagaacaaaaaagtcaacaaaaaaatcaacaaagaaacagaaacctagtagatacacaggcaagctaaatatttcaaataattcatgcaacagacagagaaagtaagttaatatttaattctgttctctacactggtaattccttttactgaatttaagaaaatgcatcggccttggtggtctacgagaaactcactggaagaggctcgtatccttgcatcctttctccctctgagtacccccatgttccacacggatcaggattgtcttgagactcccttgaggaaatagaagtagaagtgaccgtcaaaactgaacatattctacaaaattatggtattaattttttaatttttcattgactttgactgcttcatatttaaaatttaatcatagattcgggagttctgatttatcacatagattttttaaagttgtcaacttgcaattgcattagtcgaatcccaaagcttatagagagggccaaaaaatatattgaaaaacattttataaaaacttaatagggacagtcgtcatttatattttcagaacattacagaaagagaacacatgtgaaccggcagctgcagccactggaaactcaggagaacccatgaggaggtgaggagaatagaaatcacagtgcagagattaaaaactcaggcagaagtgcgcatggtctgtaggcagaagcagcgcctctgaacacgaagaggacatttggtgttgcttccctccatcatgccaggaggcagcgtaaatagaatatttaacaccgtgtgatttcagcaccatgttggatcacatggttctatgtcatcagacatcggctcccccatttgtattaagattccatgtaggccgggcgcggtgactcatgcctaaaatcccagtactttgggagtctgaggcggggggatcacctgaggtcaggacttcgagaccagcccggccaacatggtgaaacctcatctccactaaaaatacaaaattagcggagcatggtggcagtcacctgtaatcccagctactcaggaggctgaggcaggagaatggcgtgaacccgggaggcggaggttgcagtgagacagatggtgcccctggactccagcctgggtaacaagagtgaaactccatcaaaaacaaaaacaaaaaaacaaaaaacaagatgccatgccacctgttaagcagaggtgcacctcattcatggacatataaatatacattttattagaggttccacgtgctacttgatgttcatgtttctagcaaatctatgaagattcctcttgagtttccctagatcctttgctattcattctgttgggtctttaacaacatttccgttgcaaatcactaagatctggcttcagggtccttaatcgtcctcctggagtccttaaaaccaagaatgtgaacattctcataatttcttctggtttacagaagagacaagagtttctcatggccatgtcctggggtaataaaatccatattgttccctcctaatcaatctcgtttcagatttactgtttggtcggagttgcaaaatgagctgctgcgatcttatgctggtataggattctctgtgttgatcaccgtgcctctactcttagaaagactgtttcaaaggcttcggacatacagcgttctggtctgtttagttgattaaattgggaggtgcttctgggcatgcatttagtttgtaaaagaaagtcccttgttcaagaggttcctattcaactgccaaatgtcacataaaatgattattttagagcatgattgagcattttaagatttctcacaaaggaaggtttttaattttagagcagcacctaacatagactacttagtagtttggtagctcagtatgctgaagggaaaggtgagaaagaattattgccaaattactgaatcaaatgttgactgacaactcttccctgagtgacagaaaatgctgggagaggttgtttaaataaaatgagggatttttttggtttgtttgtttttgcaaattatccagagctttgctttctaatttgacagctttctagaaatgcacttatagatggatacttcatttaaaaatctccccgtctttctcttggtaggaggttagatttcttcttcagtgatttaaaatggtaatatgtatgattcctctgtggcatctacacatggttattttattgtcaaaatcatcctttggtgtgtgaaccatgtccactactgacatcaaagcaaggaacctttacactttttaaatgtggtagcattttcttaaatctttatttaattttatgtcaagttacgatggaatgaaatttcaattatgccgtcacctattttctgatgtggattttattttcattttacagagatttcaccaagttaaataacttgtacaagggaaaggggaaaaaaaacacaaacttatagaccaggatcttaaacaacactagtgaccatgaccacccatctccaggctgctgcatggaagaggaggtataagtgagagattggagcaatgtttttcagcttctgagcattctgtgatgttccattaggaagcaagtagcgagagcatgggcctgggaagccctttctccacccagcctcatcttttgcagctacagccactctttttatctttatttatcgagacagagtctcactctgtcacccaggctggagtgcagtgtcacgatctaggctcactgcaaccactgcctcccaggttcaagcaattctcctccctcagcctctcgagtagtaacattacaggcatatgccaccaagcctggctaatttttgtatttttagtagagatgtgcttgcaccatgttgtccaggctggtctcgaactcctgaactcaagtgatccacctgcctcggccttccaaagtgctgatagtacaggtatgagccactgtccctgccctgcattaggtcttagtaaagaagagtagtcggtttcaatgccttgaaaactttgagataaatcattacatctgaattacatgaatctttcttgcaagaaaagatgatgtgtgatcgaatataaccagcagccaaatcttgtcctatactggatcagtgttttctctgttaattttgtattgtaattacaaatccccacccatcttcagcattttggttgttgaggctgcttaaatgctatttacacattagataatacacagaccctgtagtaagagcaagcttaatgactaacactatcagctttcgggatttaggacagtagagcctcagactgtgttctatgtagagaaagacatcttccttagcgaatattccatctgaaatacacctgttctcttggttattgttcaaaccttctgaaaatctgaaaaaaaatggcatttgcagtatgttgctttattaagtattttgaatccggaagatgtacttaactaaaaagattcttaaagagaaaagcattgtgtgggttgctgagtgtgtgtccatgtgaacccatgaaggaagaagagccgtgctcagtgaccacactgagctggtgcccaggttggattcttgtaggatcagggagattatagccctctgtccaggcaatactcatgctgcctatgagtattgtccaggcaatactcatactacctatacctggaaaacaaagtacattgagaaatatgattatggcacattgttttttattatttattattattattattattatttgagacggagtctcgctctgtcacccaggctggagtgcagtgggtcgatctcggctcactgcaagctctgcctcccgggttcacgccattctcctgcctcagcctgccgaggagctgggactacaggcgcccgccaccactcccggctaattttttgtaatttttttttttttttttttttttaagcagtgacggggtttcaccgtgttggccaggatggtctcgatctcctgacctcgtgatccgcacacctcggcctcccaaagtgctgggattacacgtgtgagccactgcgcccggccaattgtggcacattcttaagcgagcaagggaaatgctgtcatcataagttactttccttatctataagcgtatattctcaagcaaattggatatgtagattaaggtagttagttcacacgtaatattaaattaggttctttcttcttggcctttgttggactcatctcttgcccacttcccttattttccctttgaagctcaccccagcacgtattgacaaggacaattgtaggcagggaatggaggggaaatgtgagtaatgcacgtaaaaataaatcagttgtgaaccgtctgactctacacagaggtcaagctggtgatatttgctgaactcactcatgcttcatttatttcagttctctttaattctccatccaagtccgcaacacatgtatttcaacaactttccatctgtttttttttttttccttttagcaaagatcctgaatgaggactttgaaagcatcaggtgatacaggttgaatgacaacctccctagagaataatgagcctgcagttccatgtttacaagttcagggtcggaatggagaagccgtaccatcatttccattcaggtgtaagggaaggaacaaagggaacaagaacagtatagagagagaattaaaaaagcagaagaattagatcagaataggaaaatagctgaagtggggaagagcaaagcagtagagagaatcaagttagaaagtgaaaaggaatacataaacattttaagtagcagaaagatgcaaatagacaaaattagtccgtttctctatgaaaatcatggctttctttccttgttagaatagcttgctcatgtctgatttcaatatctggattacctcaactaaaacggccttggagattatttcaccaattgacactctacagtggaagatgtaccctccactcctgaaaacagaatggagaatttgaattatctcttgatcataaagaccagccttttaattcatcggcattcaagtcatactgaaaatctgatacatccagtgtgttgtatgcagcataatagagcttagtgtctgtacagaattgattaaaatagaaaatacattatttcttgggatttaatctaagacctataaatcagtgtgtgtgcgcgcgcgcgcgtgtgtgtgtgtgtgtgtgtgtctgtgtgtgtgaatgcctgcagcctgccaggcatggcatacgctgtggtggcagatagcatgaaacacagcacatggtctttgccctcaaagaccttgcaggctaattgaaaaaataatgaatatgagtagtgcatgccaaaaactgcaaaccaatgtttacagaaaagaaattggcaagaaaataaacctgaaacaaaagaatacaattttctcccaggaactgattctcctgtttctcccaataaataaataacagaaatggaaacatatatctataaaaaatatatgtaggtaattatatataatacctgatatatatgtattatatatttatcagaattgttttcaagacgcaagacttggatgtttataaatttgggagagtgaatgatgactgagcaagatgctatttctttccctcttctccatcagttactgtccaagcccctctgcattcagtttaagtatctttgcaatattgattaaatatgggcggaaatcatttagccaataagctggcaatctggcatattttataccgtggtaccttagacattttctcctttgccgtcctattaactgagatattataagtagcatggatgggagcctattccctaaattatgaagtacattcgtagtccctactcctggacattcgttattttattctagagtcattcattctctcaccagtgtcttctgcttctttctaaaattgaatctatgcttcatattaacattttattctcgctaaattatgctttctcaaaagaccttgacagttcttatttcttataaaatcataaccattggccgggcatggtggctcatacctgtagtcctagcacttcaaaaggccaaggctggcacagtatgaggtcaagagttcaagaccggcctggccaacatggtgaaaccccatctctactaaaggtacaaaatattagccaggtgtggtgtcacatgcctgtagtcccagctactcgggaggctgaggcaggagaatctccggaaagtgggaggcagaggttgtagtgagctgagatggcaccattgcactccagcctgggcgacagggtgagactccatttcaaaaataaataaataaataaataaaaagaaattttaaaaaatcataaccattaacactaaggcctggaattgaaagacctctctttcctgacctagttgttcaggctctattgtttcagccgaaccatagtttttcaactttactttggttttgtgatatcgtctactcaaacagagaattctacgcataaacattctaccctttttccgaaggccatcacgaaaaccatgtctctaaggcaatgtatttgtagaacgcttgttcacacaaactcttcaaaacattgtcttatttaagcatcaaagaacattatcttcatggtagcatttcagaaacccatgcttagagacctgagttccctgtttaagggaggagaccaaaggctgagtggaaagcatttgccgtctctgttcaagttcagcccctccttccgcccttgtctcctggtcttttgttatgaactcttactgttaaaaagcaagaaactattaaaatattaataacacaattacaataataatagcctgaagttatccatttactaagtcagctactgcggcgagtgctttatggattttatctcaatatttacaagcacattgtgtagaaactatcacctactttatacacagaaaaaaccgtggcctagagagtttgctgtgactctccaagaattacatgacgaggataaacccccaaaatgaagacaaatatttaagaacttaattgtattgaactttttaaaagtaggcataatatgcaatcacactttttcaaaagtggaaaccccactaagtgaataaccgtgtattatttcatttgtgagcttaacagattgtcagcaaataattgttggatacattagtcctttatgaaggatacaggacaatgtatgtgtcacgcaagtacattgcaatggattttgaagcgtttatttaataactatggtccatttaaaagtaaaaatatagagacacctcaacttgaatagcaaatttaaatatttctttgcaactagctaaaacattacaattgggatttaagtggatcagagaattaacctgcaagacttctccagtgtatttatttcctggtggtgctcatttcttcctatgagagcttggagtatggcaggctagaaagagaatacaaatgcggcaaaatgaggcataccagcacctgtgtctccttccactggctgattaaggcctcagtcaaaaaacaggagctatgctaaattatacgttggaattgatacaaacaaatgtgaattaagttgtaccagtgctcaaataagtcacggtgacacaatgagacttatggccgcgtgactgtggaacgctccctaaagcagcctgtgagctctaagccccaaaggagggatagccacaaaaagtataatttagtaaatcactctcatttatacagtctttaaaaaaataaatgcctttaatgtttacttgttaagatgaaaattggtcttcaccctcttgggtgaattttacgcaaaacttttttttctgaaagcaggttctttttactgttgacaaaaaagttattcaagcaagcacctcatgctgtgctatcaatgaaagtaatttatgcaaagcatgaagtttctttgtgcattctggggatgcttcaactcattctgtttgacttaatacctttaaatccaacgaactttttcttctttttcttctgaaagggaggaaatttgggatacaatgagttagaaattcttccgagtgtcagttaacatctataccttcatttcttaaactgcggttttaagattatatttacatttgatgttgattttatttcaaaatattaagtttctgtctgacttaggttgctatacatatactatactattgtgatattcatatagcttttgttttgctatcaaaattattgcagtttgtctacgatgaaatctatgtatattcacttacacacatacaaaatcatacgcacatagctttagtatttaaaaatgaaacaatataccatatgtgctactaaatttaaactttattttttgtttacttagtagattttaatatttttaaattgaaatacgaattttatgtttataatagaaaattttctgaattttaaaatgtacaccccaggtacttctattgcataatgttcagttatgaggcattcattcaccttaagttggacaaagagaccagcgagatattttcaagctacttaggaaccatggagtataggatgtcatatattactgaaaatcttgctaagtaaacaccacacgttctttccaacatatttaattggcttatctgggtgagagccatggatttggaacctttgtttttcatgcattcctcaaactcgtaattattacaattacaatattcaaaacactgaggccgggtgcggtggctcaagcctgtgatcccagcactttgggaggccgagaatggagggttactggaggtcaggagtttgagtcaagcctagccaacatggtaaaaccccgtctctactaaaaaacacaaaaattagccagacgtggttgtgcatacctgtaatctcagctactcctgaggcaggagaattgcttgaacctcggaggcagaggttgcagtgagccgagattgctccaccgcactccagcctgggtgacggagcaagagtccatctaaaaaacaaaacgaaacaaaaactgagtgaaaagttttgtggaaaaaatagacataatgataaaaacaggcttcagttgttttacagcttgaataatagaaatcatgtctgttttatcacaacatgtaaaatgtgaaaagaaacttattgccctcaatgtttttaaaaatatgaatattgtggaaacatagatgccagcctctgagagtgtccagccttgagtccaacccgaagagtctgcaagaaagggccgcacctctgcaccacactccccacccagctgctctgatttccatatctaactgcaattgaatgtccatgctctccttttcagccaatgatcctctcctttcctcttcatagcatggatttcattgcttactcctcgtgtgaaatcatgacccctacactttgcttacctgcgattagcctattacgttaatataggggttcctgcatgctggctgtcataaacagggggtgacatccaaggagatccatgctccctctcacatcacccagctgagaggtgagggtggtagaccttgaattcaggactgcgtggtgacaacgcccgtgctgcctgactctgctctagtgcactgtacttgggatcttaatcctgcataatctgtcactgctggaaccaaatcccaagttgaatgtgtagggcagttccaggacagaagaacctcatcatgaccaaatctggagtgaacagaagaaaatcttgacaggtgcaaaacaatcccattctggaatgtggtatattcaaaccacctcagcagagcaggtctatgaagtaggtgctcaggtgtgggctggacacagaaagaggaggaaggtcctggctgggtctgagtccaagctcaagttatctctgagaatgatggtccgtgcaccttctcacatgtccaggaactctgaggaaataagatgacacaagcacgcatgtctttgtgcaactttgtgatgttttgctgcattgcttttcctttcaatatgtggtatttgaggaagaaagcgcccaagcccattcgtttttgagcaatgactcaagaagtcgtaaggcaggatgcgctgttttaggactaaagggacatctcttcctcatgatgctgccttatttatttaatagcatttctagcgggaaatattaaaaacccagtgcaccattatcaaagctgatgccttcatcatgaaagaccgggctttactacatacgcaggaaatgctcccatgagtatcgcagcaatctttttcttttttgaagtttgctttcactttatttattatttgtttattatcaagaatgttacataaaacagattttgtgttacaaatggtgcctgagtaaattatgatctcaaagcgtttttatagatacctttagtggaaatttctgcctaggatagatttcctattgtcttcacaaagcaagaacaaaatcttaataatgaacgcatatggggctagacttttaaaatgtcatttttaatttaaatctgtgtcaaagatcacctgtgggaatatttggcacttggggaaaataaactgaaactgtgtacagtggagtctagataatcagaatccttgttcttcagtggcttacccggttaaaaatgtttccttaattgaaaggatgacttttatgctcatataacttttatgcttatataacttttatgcttataactcagaatccttttttcttcaatagcttacttggtaaagaaaatctccttaattgagacaatgactttcatgcttataggcagagaaaatgataacttagtgaaatacagagactattatgggcaagaagagatgcaatttttaattattagcttcttggagactttgtagcctttgagtttgttcatgttcaattttgtttgatttctgaattatcttttcctcttttttaaaatgggaattgtacaatttataattttcagataatttaatatatttttaaaagaatttaaatcatacaatattaagaggatagtattatccatttattccagaggaataatctaagtctagaggacttttgtgatatgagctttgtataaacattaggtataaaagtgtgtcattttatgacaatgttacgattgcaaggtaattttaattcagtaaaaataataaattgtaattttccagtttctacatatgtttttatcacttcttgattttaaatcaattaattataaaaatgaattaaatttatccttaaaaagaaatatatcttattaaatttatctttataaaaagttttatcataacttcttgatttataatcaattaatcagtgcatattaatatttccattaatgttatatacaatatttaaaataacttttttgctttatcagtaattaaatcctcaagactaaaaatgctttcctaattggcacacttaaatgctaatttttaaattttctcaatatttataagaatcagtctttaaaggcataaataatattcgcccctgtgttgaaaattgtatttctcactagcattgagggactatctagtcttctgtctggtgcatagaagacattcacgccatgcttttaagtagtagcgtgatgaggaaagggtgtcaattacatttggaaagtttaatgtactttaaaggtttgcagagtaacatttgctaaattccttattagatggcacttaggatttgctgtttccagaatgtgaggagaggaaataaaattttcttagaaatagattccatgattgaaagaaaaattcacaagtaaaggcaacatacaagaagatacgctgtaaaaaatgtctgtaagtttctatcattatcattttgaacaacctgtgtttccacttagctccagcactgttgtctaataagatgatcatcctgaaacacattccctgagatgcccagaaggctccttgcaaaggcttgaaatagcttcacgcacatactgtgattaacacactctttgttatttcgtaaatgttcaagtaccacatgatcaaatggctagtacagggcttcagggaatacccatacatctaaataataaaaggaatgaaggcagatcacacgttatatacctcacaatatagaaagtttttctctacatcacttggtgtataatgccagaaggtgctaacaggtcagagtacctgcagctattccaatcacaaaactgaagacatacctaagtttgagtgtgttcccgctgcagtttcaaaacattctgtgttcaggtatatcatataaagaaacttacctgctgtactaggacataagtcaaataagagaaagcatggcaaaaacataaattacaagtgagatgctgtgatttggagcatttggtcaaattatttttagattaaaagagacaaaaactatgggaactctttgtctctcttttctttctttcgttcgttggtttgttctttgattatttctttcttgacggagtctcgctcagtcatccagtctggagtgcaatggcgtgatcttggctcactgcaacctccacctcccaggttcaagtgatcttcccacttcagcctcttgagtagctggtactacaggctggcgccatcacacccagctaatttttgtatttttagtagagacagggttttttgccatgttgcccaggctgatcccacatttctggcctcaagtcctcctgccttggcatcctaaagtgctgggattacacacgtgtcccaccctgctctgtctagaaactataagaattttttaagtcagtttttaaaaagatgccctgtaacttcttatactcaaattatgcttttaaatatgtaaagactggtgtgcgatataaaagtgaaagcatgtgacagaggcgttgttaagagctgagcttgagaaacatggtgctggggagtaggaagtatggaggagcatggagaagccgccgcagagtagggaggagggagacgcatgggagaaggcccagaccgggagctcacagatcctaagccaaggtcagggctcaaaaaatgtgagttgcacaaatgattgtatattagaattgtcacgttcactgaatatctgttctctttttccattatcatctacttacacttcacctactacacaatttcctctgcagatcctcctgatgtgtatcatagataaagccataatgtcgttcctctttgaactggacagaagggtgctttgtgtgacctcacccatagtatttaaaccacaaaagcctcatgtttgaccctcagttatgtcctgatccatttccctctttgacattttgtttttataggctaatttgtattttacaatatgtggtggacctcatttaaattattcaaatgcgggtatgtgaatggataaagaacaagcagataaatgagtaaattgatacctcagtaaatgaataatagaactaaacccagaagaatgcatttctaaaatgttagtgataagcaggaacaatttcaattataattcatttttaaaaataaaacaaatatttcaaaaacgtgcacatgcttccatgaactcaccattttttctgcctcctttttggtttcctagagagtgaaacagcttaaaagttaatgttcaaagagcaagttggaaaaaaaaaaaaaaaagagagagtttaaaaaaatgaaactttttttccacatccccacaaaaaaccacattgtaatattacaaaacgatggaagacgtagtctatcttcatgtttggttatggatttctgggttaagatatttgttttctccaaaataataatttcatttgcttgccagaaggacagaatgctcattaagactttggcagcttcattaacatgttgactttttcttcaagtagcattatagtaataaaagttaagatagcacatgaacagtatacaggcacaactaagagaatgatattctattagttgtcttctctggtttaatctagaacgttaagcaagcaaaaagaaagtaaaaatattttcaaatattttataccctgcaggatttgctgccctgagaagtagatcaccagccaaacaaaggagattattatacagcgatagccccacatcggctccaaatgtgcctcttatgggctacataatttgtgattatcccttcatttcctctgagctttatgaaactaacaacattattcttcttggcatggaaaatagatattcatacttttcttttttcttttctacatttcttttcctttttcttttctcttttcctcttctcttcttttttttccgacatggtcttgctctgttaatagcccaggctggagtgcagtggcatgactatagttcactgcaaccccgaactcctgagatcaagccatctgtccacctcagccttctgagtagctgggactacaagtatgccccgccatgcccagctagtttttttaaaattttattttttatagagaagagtgcggccatgttgcccacatggtccaatactcctaggctcaggggcttctcctgctttggcctcccaaagtgctgggtttacaggtgggagccactgctcccagactgacatatatttttatgcttaacacctgccttggtgcctagcacgtagaacacactcataaatatttgttgaatgaaagaaacaactaaaaaaatatttctgagggcacaaaagtacatgtatccccactgcgatagtgaaacctacacacaaagactgtctttgctcctatatttctgtcttctcattttgagaaatgttttagttctgcagttacatcagggatctagcagagctgggtgtgaagtagggggagaaagaggcagggcattaggagcaggaacgtgaggaaatagtttccaaagacatatacagagcctcccccggcgtttttgtctcctacgttatttcttccttctgagataggcctgtcactctctacttccatgtgggtttcattttttagggcccacaagaaaaacaggtccaacctttccgtatagaaaaagtaatattctttttagatatgaaaatagcctttagtgtttgcaacaatgcagagataatcacctgtacatttgcagcattccaaggagttcctagtcaggaagagccaccaacattctctcttccttccgtaacggctgggtgtccttcaagctcctaaatcgattcttccagaggctaaaactaagctttggagttgggctaaagaacgttcagcccaactgaacttccttagagtagggtttcaaatataggttctgccacatcgggtagtaactcataattttcagtcgtcttatccaaaaatgaaaataacaacattttagtcttgttatcagaatttaatgattatgtatgcaaaacatggggcacagtatttgatacatattaagtatttgataaaaagtagccattatttttactgagtttccacctgtcctctttatttttcctacaatctctttaggaatgtacgtggatgattatgaaactcaagctatcacaaggcaacagcatagtggctaaacatacatgcctccagttagacttctgggcttcaaattctagctctctcacttctaattgttctataaggcaactgactaacatcttgctgattcagtttccccatcttgagatggggataataacagttttgatgtgatggtttcattgttttaaaagtcaaatgtattaatttgtgaaaaagttaacaacaccacctggcacattatatgctatctacatttagttatggttaataccccaaaattgtacaacctttttgcatctaagattattagattttggtccaggatctggtcagaacttaaaagggttagaaaggaaacctggccgagcacggtggctaatgccaaataatctcaccactttgggaagctgaggcaggtagatcacctgaggtcaggagttcgagaccatcctggccaatatggtgaaaccctgactctactaaaaatacaaacaattagttgggcgtggtgttgggcgcctgtaatcccagctgctttaacccgggaggcaaaggttgaagtgagccgagatcgtgccattgcacccagcctgggggaacagagatctcagtgtggcagggggcaaagtgaacccctcagttaatcaaccagagatatgattgatttctaagggatattaattcactgggtttctatgtatttgaccctgtttttttcttacttgaggcagttctcgaagaatctttgtgtccacgtattcatcctctttcctcatcctctgagacactcttttagaatcggtgaaagaggaagtagtgaggtatttattgatgagatattcaatactacaaaatggagcagggcaggtagcaccaatctcctatggaatatgtaaacattttttcagacgccaaatcctctactgacttattagaggttggctgacagcttcaaacatgagtagagagaatgacatatcagtacaaaattctactttatttctacattttttcattctggtttatttgttgacctgtgtcttaaatggaagcttagagtcatttttggaaaatctctgaaccagtaagatgagggatgtatggtttttgtttctgtggcgtaacatggagtttcaccaagaacacactggatgtgtgtttggtgttgacactgcatgcctcttttgcatgttggttggcattgccggtgggatctgtgggggcctctcacaggagagagaggcgcattcaaggtgctctgcacgtggtcacgggtggtggaggacaggaggacagtcagtgcttctgtcttcccgttaccggtagttaggtatgaggggggcaggagacggctttcccgcacccactagaaatgtcaggtgatggttcataattatcgcattgcctctttgaaaatgataaattagcagtgcaaaggagaggccatttcctgatggtccacacttattaacatcaaaatgttaactgaatgcagaccccagggagaaacaactttctgtgcataagtgttaaaggacaaagatggaggagcatgagtttccacgtaccctccaccagaataaggaagaaagactccaatgcacatgcatgtaactccctgccacactgcgcatgctcgcttccgaggggcaaggaggctctgcgtgcatgtaactccctgccacattacgcatgctcagttctgaggggcaaggagggctctgcgcatgcgggcagcctgccctaagggaagaatcatgggaaagaggggagtctatacaagtcctgggatccggccaggtgcggtggctcacgcctgtaatcccaaaactttgggaggccaaggtgggcggatcacgaggtcaggcgttccagcctgagcaacacggtgaaaccccgtctctactaaaaatacaaaaaaattatctgggagtggtggtgggtgcctgtaatcccagctactcaggaagctgaggcagcagaatcgcctgaacccgggaggaggaggttgcagtgagctgagatcaccaccgccactgcactccagcctgggcagcagagcgagactccgtctcaaaaaagaaaaaaaagtcctaggatcccagttaaatggctcttgaccttctctcttcagccttcgcgtgcatgccctggtctctcccaagcgcaccttcctttcctgttctaaggtcttttaaaataaacttccactcctgctctggacttgcctgggtctctttttctcctttatgcccctcagtcaaattccttcttctgaggatgcaagggctgaagtttctacagacccatatgtgattcccctcgggaaactgggatctctcccactggccacgttcctaggcccctgcacgagcttcctagaggcggggtcccggggacaggagctcccaagcatgtgccccgctcaccatgagcaggtggcgctgagacctggaggcatcaccaccagaggaaggaagggctcctgtgcgctcccagcctaaggcgagacccagagccacccttgccagggccgttccagacagtggcccagagcacagtcctggggcctgcacagcacctcacacaggagaccacccagaacattaggctctctaggaactgcagggaaaatgagacctctcatggctgtatagctctgaggtgttgcggggcttgtggataagctcagctgtcacgtggagcagctcaggggctctgtgggggaagcttctcctgagtccccgtgcctatccacccctcacccctccccgccatcacttccccaggctcccagtcccagcgttcttaggtgaggcacctaacatagaaaccttgaaatgcgtatgcttgggcgcagtgacccactttaatagctccaattatctatcccagggaagtcctgaagctgtaaaactccactcagggcaatgtcattatcttttcccagtgaaacccccaaactcagcccatacacctctctctgtgtgtgtttatggtctcttctctgtgcaaaataatttttgagtagaaacattctatatactcattacacatgaatatctaagtatatataaacacctaacttgcattatatggcatgtaatgtttatacatactatgtaaaatatatgctaaataatcttttattttatgagagaatttctgagttgaattctcttaatccagggtaaaaacttctccttaactcctatatcagttatatattttcttgattttaatcctataatgtttatagtgcttctacacaaagtaaaatctctaatccagtttgatttttttttataaatggtattttttagggtttatgatcattgatcttttcagagaaagcttttgattttcttctcctttacaaatactgtttcttttctgttcttttcattgattataattttgtctttagtaaaccttctcatgtatttttttaaataatgttatttttctaatttttaaatagtgtattctggaaggttgttttgtattcctttctttttcattaatgaagacataaattgcactcaatacagctttcgctgagttgccttgggttagagatgatttgttttttgctcttattttcactgcattcaaaataactttctgcttttatttctttgattaatgagagtattgcttaataatcaagtacttcttttgtttttattgaagtgaaataaacataacatacaataagccattttaaaatgtccaattcagtgacatctagtgtattcacaatgctgtgcaacaataatatctctttgatttcagaatctgtaatcaccccaggaaaacagctctacccattaaggaatttcttccattctcctctctccctgtctcttggtgactgctgatctgttttctgcctctgtgaatttatactgttaaaaaattttccaaacctgaaggaggttttgtttatgtggcttgtatctgttagtactagaaagtaaaactgagttaaagtgtatgtgaatcaattaatttatgaaaataattaccctttacatatcaacatacatatttttaatgaagaaactaagtagaattaaatctattttatgtttggttcaacagaagatggttgaattattctattggcttctgcatgcaatttatagccacgacacctttcgcgtagcctctagaagtatttactgtgtgctcaggagaataagagtgaggaaggcccataccatcttaatcttcttattatgaaaattcttttcacctcggagacaccatgaacagtttctgctctgtcccattgaaggtttctgcgaccatactttgtgaaccactacttaaataatttgttctttctgtcggaaatttaaagatttttatttttattcaaacaactaatgaattttacaattatttacctaggtcagtatcttttcatccatcttggacataaatggtgaagttgttccaagtgtaatcagggaaaatttcctttattattactttcataattatgtattcgatatctatttttttttctgggaaactggttatttaagattttttttcctccaggatagcttatgtagtttaatgtgcaagttatgtatttaatttttctttttgggttaactttgagttactatttttcacttctttgccagctcactaatttgttctcagcacaggtcaccctcattttctactcatctattacgttttaatgccccccatgttgttaatacccatgaagtctcattttaaattagaactaaatatctgcaaatgtttattttttaatttttaaaaaattttaacctttcttccaatatttttgtcagctgtttcctagagtagtagtatttctctcgttgttttctatgatgattcatatctttggcgatgtattttacttagatagatcatcatatttacatggttaatttctggggctcaggtcaaccagttgttattcaagcagttggaatcccacaagcggaggaaaatacagcactctacatcccactaatgaacagagtttaagttacattctgccccaaatgccttttgcattcatttaattaacaaacttattgaattcttgaattcctgctccgttcaggacactgggctggtgcttaaaacgaggagaaggtgccatggaagacacaaaggtgggccagggctgaggaggaaatccactctggcctcagtcaccgtcagacccgtgcccgcctgtgcagtccccacaaactacctatacaggtcttgtctcacatggcaggaatttgcttcaaaacttctgtctttgtaaaacaaacaactttgagacatctcctgcctataaatgtagatatattctttcagattaatgtataaaattcaagtattattttcaaatagttgaaacagctttaaaaatctcactaaagtgacttttgtagatcagaaacggggctcagttgaattatgcttttactgtaactgttatgtgatgaaaagaatcgttttttcttcttgtctgttcagggcttattatgaatattggttttccttattttttattaagtattctttgaaagagaaataaaatgaaatttaatcttttaaagaaaatattctacttagcacagtattttaatatactaaacctattatgaccgaagaatatgtttataccatgtactgtttgttagcgatgaggtaagagataaaaaagattgaaaaccccaattacattttgaggaagaagttttatcctgtgctccataatgcattattaaagtggcaggagaaacattaactttttaaccatcatgaagaaaaagatcaaacacgttcctgctgagccacgacttaatggtggtttcatatttcacgcaatattgctatgggcaagcggaacgcttgtattgaggctctgtcatgctgagaaaactggcagcaagtggacggagtctgcagaagtaaaggggcgtgttatgtttgtgcattagcagctgaaccactcatgcgttggagatccagaagaacctctcttctgctacttacattgacccgtaggccgattggaactgtaccggagagttttccctgttcttaaactttatgcagaccagctagagtcagatggcttttctacttggaaactatcaaactggagaataggttcttttattttgataatttgtgtttaagtatcaaactactaattcatcatcataattcttccactgcatgatgagaaacttcacagtcagtattggatcgtggcctctagggtcttgtggtttacctttcttctgtaagtcagctggtgtataaatgcaggtcagtgtaacgtgtctaattattattatcattgcctttaaggaagattttctttttattttctggcaactcagtcctgtctgtagcgtgacagcaaatacgcacaggaaatgccgtggaccctggcaaatgtagtgggtaatttcatgcaagcctggagacacgtcgctctgctggcatgaacctctccatgtgtgttttcacgtcctgcctcaacacctggagcttcccatggaggcacaatcttgaattggggctgaatgaggaggccatgtccccagggatcccctcaatcaatgaaagatggaagcaggtcattgccccagctttccatgtgttagaggcaacagtgcttgtggctgtcttgtgcgcttcttggagatcctggtgggatcaagtccccattgctcataccatgaatcaggaaatgtgcccttataatattcctccttctcctcctcctttctctcatcctcgttgccccttcaatcttgtacctaaaatcatctcccaaacaaaccacccaccctcatgttcttcaattagtttcccccacacaaaagaaccccaaaataaccccaaattagacacacttaatgttgctagcttctctctttgctcctgacagtgtaataataaccttttaatttatatagtattggtgcttaaaatgtatccttttccttaaattgttagagcttctatatacctcatccatgtgatagttagaatagtctgagaagtaaagtggttgtttccagggactgtgagattgaggtgttggggagatcttggtcagaggctacaacatttcagtgagacaggatgagaaagtttaagagctccattgtacaacatgatagctgtagttgataacattatattgtattttttcaaaattgctaacagaagattttaagggttgtcactataaagaaatgataaggatgtaaagcaatgcatatgttaattagctcaatttagccattccacaatgcatccatattttaaaatattatatcgcacatcataaataggtataatttgtatttattaattaaaaatagcttttaaaaacagtaatatcacactcatgaattagaaaattctagttcagatttaatacattttaattgttatatacacaacttcttaccctggtgataaatattttccagtagcccatcctcagttattctactaatgctttttgtaccagtcagtgttctgaaaaaaaaaatctccttttttgttagtttctgaataatgagaacattgaaaattggataccccttgcaaataaaaatgtctcttcaaaatgataactgggtagtaaaactgcttttgattgtaatagtcatattgaagaaatgctcatcttttctagctgattaagtcactgtattattgattgttggttttattcattattaagttggtggaatagaactcattggtccttccattatttctttaggaaagttgtacttttagataatggaaagcagtaagtatgtggaattgatgttaaaacacgttcatcgtttatcatgagcaagttcacagtcaagatctttgtccagcaaccaaatataatatatataaaataaagaaaatataagaagacaaactattcaaaacaacttctggagaaaatttccctgccaaagaagggtcacattcaaagtgtgtcacaaaacctaacgtctttcccctatttttcttgttctccctccctctcctgtatgcatcagtgcttccaaagtgctcttcagtcatttattaaagcctctgtcccaaattctaagccccttatactcttcaaatgcagactaacatgactttttgtttttattttttaacaaatatatatagcacatactatgtctgcgacacttgttgttattattattattattgttattatttagacggagtcttggtctgttgccaggctgcagtgtagtggtgcaatctcagctgactgcaacctaagcctctcggttaaagcagttatcctgcctcatcctccggagtagctgggattaaaggcacttgccaccatgcccagataatttttatatttttagtagagacggggttttaccatgttggccaggctggtctcgaacacctgacttcaggtgatccacctgccttggcctcccaaagtgctgggattacaggcatgagacgccacccccagcctaccattggagattttaacaggacttttaactaatagaacaggtagacataagttgaaaaggctgtggaggttttgttagccctgttaacaaatgtgacctacttgaaccatatgaaacacttccccttgaacagcggaagacacagtcctttcaaccgcacatggaacattcactaagataaactatattctgtgccgttaaaaaaaggcttagtcaattaaaaatgtttgatactatgttatattatcttatcacaacataattaaactgtaaattgataacagaatatgtgggaaagctcctcgtatttggaaactaaacaaaacacttctatataacccatggtttatttaatttccaaatataaggagctttcccgtgggttatgtagaagagtgttgtttaatttccaaatatgaagtacatattacctaaaaattaaaaaattaaactggatgaaacgaaaacagaaaaaaccttttaaaaatgttgtgaaataagatccagtgatttataaaaaggatagcacgtcatgaccactggggtcactttcaggaatacgagattggtttaacattcttgaaaatcattgtaattcataatcttaacagactggaaattaaaagctgcatacataatcacgtcaataaatgtggaaagaacattagataaaaattcagcatctgtttatcatgcagcttttcagctgactaggaactgagagaaacctcctgaacccagtaaagggcatccatggaaattttataactaatttcttacttaatgatgaaagactgaatcaattcctcataaaatcagaaacaaaaataatatccacttttacaactattcaacatgtaatgaagttaccaagcaagtgccatgaacaagaaaaatacagacatagagattagaaatatgagatccaacgtatttatttatatgatgtgattgctgtgaattttgttttaaatctatacaaaagttactagacataacaagtgaggtggcactgttgcatggtttgagatcacaatataaatcgatacaagcaatgagcaatttcaaaacaaaatttttaaaattataacatttacagaattaaaatatgacagatttagtaataaatttaagaagatacatgcaagactgcatgctgaaactgtaaaacatagctgagagaaattactaaagacctaacaaaatatgaaaaatgaaaaggggagatacactagaccatgaatgagaagatgcagggctttcaagatgtaagtttattcatctgtagatggtctgtaggatcaacacaattccagtcaagagcccaaaaggatgtatcatttatttgtttgtttgtttgtttttaggaattgacacactaattgtaaaattcatatgaaattgccaagggcctagaatagtcaatatgatttaaaaagaacaaagtgggaggacttacataatacgatttgaagatgtcaatattgagctaaagtagccaaggtgatgcgggattgctcaatggtatagacgagaaaatccagagacaggccagcacatacgtgataaaatgatttttttgacgaaaatgtgaggtaattccgtaaagaagagataacacttccactgaggagatgagactagtttactgtgttctctaatatggaaattacaatatcaagatgcatacaacttggaagatcaagtcatttagaacagttgctaaaccactgagatttattctttgtaataatcttatttcaaagggtgcattgggattatgtgagatcatgtgcatggaatcagttccaaggtgcaagcgataaagtcctccacagatcaccattacactttacgttagtattgaaagaaaggtaaaagtagcgcctacatcgtagaatgttatgagcaaaatttaagtaaagtgctttaaatacggtctggaacataacctttcaataaatttaagttattagtaataataatcatgatagtcttagttggagccacgtcttgagtgaatagtcagtacgttcttatgtctacagcatttctggaataatgattcactacaatcaatatttaccttttatactacctcatgtgtgtgttggtgtgtgaagtctgaaattgcttctcatctactttcatatctccagttccagcccatttcttggttttctatcccctagtaacctaaggtaaggaaatgagctttaaatgtcgatgagctatctggactgtcgtcatttcacctaagtaaaataatacatcaggcttagttaatactgtgagttaaccagtacattagtttgcctaatgatgatattaattgtgagttcttttaagagatttttttaaacttgtctctcaaaagttatatgaatcaacgcctttcactattaccaataaactttggaaatatgggaagttcacagttgaagagtaactaagaaaacaattgaaaagattagcagttagactattgaagttatttgtaatatgcccccccaaaaaagttaagccgttcatttatattgtgcaggtttgttacctttatgaaagctttgtggacatcattatgtccatagtaattttaagtataagttaatttcttattaaactagtgattatttcaatttacatgatggagaatgtattgttcagcttatattaatttttcacgtctaaagacaattttccagaagaaatagttagcttctgtttttttttttttttttttgtctttctcatggtcaaattattggcaatcattgttcaaattgtgtatcacttacaaaggcttaattttataattatctggggtcagcctgttcacattgtcttaaacatttataaaatgagggattatagagctctctctggatgtcctggacatctgacatttcacatttgacttgcgggtgaaccgcattagatggataattattagatatctttgtcatccttgtaatgtcgaagaataacaaagtgagagacagcgttcagaaacactgattgtggggatgaattagaaaacacaacccagaatcaactgtcagagctgtggccaactcatagaactagctctaattattggattggcgggggaagaaacgcaaaaacagaatagatcatttgggtatttgtaagaaaagagttgagagtatagttttgaaaagtgcattattttgaaatattgtcaagagacaaatgtcctgaggcattttcaacatagatctttttatttcccaccattccccaaaaatgaatccaccagttataaaggaaaagtctctgttggtgaatatgttggcatatctgggaatttgcatgataagtatttttaaagttgtagacaatttaaatttccttgaatatatgtgtggtaattaaaactcaaactctgcctaatctaaaggttaaagtgatctgacaacatcaaaactttcagggaaaaaaaaccaaaactagaaaggcttattttatcagttgaatatgaagaagaatcacccactcagttaattgtcaatattcagtcgtagagaggaacacatcttattttggtacaaaaattattctttaaaaaataaggcattatgcaaaagttaattatccggggctcaaactgacaggtttgatttctctactttgctctctctttgaaggagacaccttttaaaaacaccagcctgagagacagttttcttaactttttattttcaaaccatttcagacttacaaaagtgttgcataaacagtaaaaaaattctgtgtagccttcactaagattccccaaatattaatattttatcacatttgctttattctttctcactgtatatttttcttgaaatagttgagagcaaaaacaagaacatgttctttcacaaccacagtataactattaaagtcaatatattaactctgatttaatatcattgcctaattttcagacctaattcaaattttacctaacattccaccattgtgttttctggctcagaacctaattcagcatcacaggttgcatttagctgccatgtctctttcgtttccctaaataggaaacggcaattttttccttccatatcctttacacttttggagagtaagggccaattattttacaggctgtccctaaatttgggtttatttaactgtttctttgtgattagattcaggtgattcatatttttttggcagaaatgtccagaattggcattgtgtcttcagttcattatagcaggggacccctgttgacttgtcctattaattgtgatagtaactttgatctcttggttacatggggtttaccagctatttcaaatgaaaagtcactatttttctttttgtaaataatacatattttttgagagattctttgaatctctgtacagattccattttcaataatacttctgttcactaatttcagcacccactgactgatcatttttgtcagaaacaattgctggaattctgtttttttttttttaatgaaaaaaaaacaacttataagacattctaatataacttagctatctgacttttttttttttaacaaaattgagttcactcactacaagaatacttcactcttctagttctgcagttgtcaagggtgataaagtgctttgcatacactttataaaatatagaactaaaattatttaaaatgttgattgtacaaaggttaaatcaaaacagttgataaaaatcgaacaccaggaaacatcctcaattgagtcatttttatattatttatcataagataacaatgcattcagcttgtttaatgacaaacataaattccgaagttgaatcccaggtaatgtggggtaatagagagattttattgcatttatcttctctgaaaagcaggattttcctgagtaacaaaataaaacttaataatttagacctccccttagtaacgtactggtgaaactgtcacaatatatctaagtcactgtgttgtcgtgccagtattttttaaattaaaagacaaaaaaaagtatcacaatgatgtattcatttgattttatgacattatcacatcaatttgtgggacgatactatagctcaatcattgcccttatggttaggtattgccaaaatatttttcttatcccagtaactgtttaaataaccagtaataaatacagacttcacacatgcattagtattttgagcgtatgttatattaagaacacagaaatttaaaagggcattagggaaaaggacctataaatcataaacagtttttaaagataaactgaggctaaccagtaagtagaatggccggaccaatgtcgcctttagaggaaaaactacatctatctctctgtgaagctgaactgagcacattttcagtcctcatgcaccggtgtcctcctgggttgagggttatagtccctgaaggtaaattgctcatccaggcatctgtgtagaaatagtcaaatgggccaggtgtggtgtggttcaggtaccataaatgtaatgctttgccttagcagtgtcactttgagaaaaggtgcttgggttaaggtagccgtcctctaccattttggcgcctgacaccagtttcttggaagacaatttttccactggaagaggagggattggtttcaggatgattcaagcgcattacatttatggtgcagtttatttctattaagattacacagtaatatatgatgaaaataatacaagtcaccataatgtagaatcagtgggagcccacaccttgttttcctgcaactagatggtcccatctgggggtgacgatcccatctcagcgtgacagatcatcaggcattagattctcacaaggagctcgaaacctagatcccttgcatgcccaattcacaatagggtttgcgcgcctataagaatctaatgccactgctggtctgacaggaggagagtgcaggtggtaatgccagcaatggggaggggctgtaaatacagaggaggatttgctagctggcccactgctcacctcctgctgtatggcccaattcctaaaagggcacagactgacactggcccatagccagggttggggacccttttggtttaaggaattgcgctatatttttatttttccttgcgtatgagggaacagaggaaaaattggaatcaaagaattgtgtgtgtccatgctgttttaggcaagatttagctctgtagttaaaaaataaataaataacatctgggaaaaaatctcattacattctagtcaaactctgcgtgggcttgcagttgaaaaagagtttaatttttttcattaagtcttatcttcatgaattaccatatgcttattattaatagaaatgtgtaggtagtaaaatatccaaggaaacccactgctcggagagagagcactttaaaactaagcacatttaaatcaaagctccttttattcagataccttgaggatgcatttaataggaccttagtgtttcaggaatcaatcaaattttatagactgatggacagaaatatttacaattttaaacttttgagaaatcaaaaattacttgaaaattattatcagcattcattatacaatgtagaagaaaagttgtaaatggcataggatgtttccagagaatctggttaaaataatattttgggaatttgtaattcagcaagtcaggtttcagctaaatgtttaattaatacatttgctaggaacttttgaattgttctctagcacaatttaaattttactgaatattctgaatattttattttgaaatgtgcttttatttcttcttaactgtatacatatgagttatttttattttctagcataaatgataaattttaaggtgatggatattataattaccccaatttgattatatgaatgtattgaattatcacatgtagcatggaaatatgtacatctattatgcctccaaaaaataaaaacagtagaaaagtaaatgacaatttggacatatatgtaaaatatggacaaatacatacatatattttaaatgtagacataatctcggggggagaagggagatggcataaggaagaagcgtatgattagtttttaataaacttcttgggttaagttgtggtttttaagatatttgttatagtcttaataatattttaataaaaagagaactgtgtatacaacaaaacaatttgaaaaataagctactttaaaaatgaatgctagtatgaaatttgtattataaaaagcaatgtaggtatgttatagaaatttgggaacatctaggaaacccaaacaagaaagttaaggttacatattgattggcagtgttgtggtgtatatgttcttttttgttgttgttcttgaatacctatatccacacaaagaaacctatgtacacatacatacacacacacacacacacacacacacacacacacacacagaggaaataatttaaattttactgaatatactgaattattttgaaaggtgcttatgttttacttctttacaacatacatattataaacatttttgtcattattttcaatataattttcaaaataacatactgttttccccccaccattgctaacatactgaaatacaaattttgaaaaatattaagtgtatatataaattcaccaccctaaaatgtctatcattaatagatatttcagagtctgatttcttctgtaggcaaaattaacttctctgttttttggtggtagaactttttcaaaaataataagcatgagatctttcatgtttgaaacacaatgacaagcttaaaataacttgtatagtagtactatttactttataaaagaaaatgtgtaaggcgtatctgcatttataagtttttatattttatatgtaaatctacacatcttcagtatttctgtttaaaacatggatttattttttatttcagtagtttttggggtacaggtggtttttggttacatgggtaagttctttagtggtgatttctgagattcggtgcacctgtcatccgagaagtttacagtgaacccaatatgtagtctttcattccctcacccgcttcctacccttctcccaatacccaatgtccattatattattattatgccttcgcatcctcataacttagctctcacaagtgagaacatatgacgtttgtttttccatttctgagtgactgcacttagactaatggtctccaggttcatccaagttgctgcaaaaggcactgttttttcctttttatgtggctgactactactccatggtgtatatataccacattttctttatctgctaattggctgatgatcactttcattgcttccatgttattagagttgtgaattgtgctgctataaacatgcttgtgcatgtgcctttttcatatgatgacgtcttttcctttgagtagataccaaatgaatctactgggattgctgaatcacatggtagttctacttttagttctttaaggaatctccgtactgtctttcatagtagttgtagtagtttatacacacaccagtagtgtaaaagtgttcccttttcaccatatccatgccaacatttatattttcttgactttttaattaggaccatttttacaggagtaaggtggtatctcattgcggttttaatttgcatttctctgataattaatgatgttgagcattttttttcatatgtaaaacatggattttaaaagtttattcgtgatgaattacttttgtgttgggttctcttatacagtctgtcactcagaaactatgttagattggtttattctccacagggcaagaacagtttttctgtaattcaataaactctcaacaatttatgcatcttaggagatttatttattctgtcagactgttggctcaataattactatgatggaataaaaatccatttcactatacatgtaatattctaccccaccccattccacactctcatactccctgcctatgaatattatttttaagaactaataaaatgttactgtgtttgagaatgatagagtattgagcatatagatatacagttgtcacacttaatgattcacttgccttctgaaaaggtttactttgtctaaaataaagatatgttagctaaatattttactgaagaaaatgtttggattcatctgacgtgtcacattaacaacaaaggcacttgacatagattgctgagatgaggaaaacaacttatgtttgggtctataattgttgtagagtcaactcctgccattcaaagtaattaacagaagcagacttcaaagagacttgcagtgacctgctggggcagcctagcccttattcggggtctacagcatgatttccaagaaatgcctgaaaaaaagagatgcattggtagcatcggtcctctcaaatcatcccccaacagagtctgtccattgttgccgaggaaaccttctccccatcctctgtactcaatttacttatccccaccacagatccactgcacaaagacattaagctctactattcttttgaagcccaaatcaaaactagcctaccaccgattgcattcagcatattcagttttgactctattactttatgttgtattatatgcttttttcttccaaaacacaaattatttaaggaactccagcatgcagttttttcccttgtgctctgtagatttaattttttttaaacagtaaagcattttacacatggcttcatcagtgactggatgttacccaaaaatgacaggcaatgtcaatgcccaacttttattgacacaattaccagaaattaataaaatatttatttacatctaacattttatatgcttcacactttcaaaatttctactacacgatcctgtgtaatccccagaatattgttggaagtcaattaggaaagcatttttattttatgttagatgctgggttttatagttagttattttgaaattcatgtgatataacttaatatggtcaccgtaagttagtatgtaactaaacattagaactgaggtttaataaagttttataactctttaaatcataaagtttcttgtgtatgcagtaattcgagtaatatttgaatttaattataaactttaaatcataaaatttcctgtgtaagcagtaattgaagtaacattctatgtgaggctctcatgacagaaaaatatattacatcttaatcagtaatatcgtacctggtgtactaatgtggaaactataatgtctgataagatgtctgtagttattgatatgcagccgtacttcagagatattgcaagtttggcttcagatgactgcaagaaagcaagtgacatgatattgtgggttccccagtgcatattaaagttatatttacatgacactgcattctgttgagtgtgcaatagtattatgtttttaaaaacatgtacaatcatctaaaccttcaatgactcatcatctttttgctggtggaaggtctttcgtcaatgttgatggatgatcagtgatcagggtggtagttgctgagaattgaggtgacttgcaatttcttaaaataagacaacagtaaagtttaccacgtcagttgattcctcctttaatgaaatatttctatatagcatgtgttgctggttaagaagcattatacctacaggagaaattctttcaaaattcagtcagtcttctctaaccctgctgctgctttattaactgagtttatgaaataatcacaatcttttgttgtcatttcaacaatgttcacagcatcttcaccaggagtagatttcatctaaagaaaccactttctttgctcatccataagaagcagctcctcgtccattaagatcttatgacagtgcagcaattcagttctacttctaattctgtttctcttgctgttttcaacatgtctgaagttacttcctccactgaaacctttaacccaacaaagtcattcacgaggattgaaatcaacttcttttaaactcctgttcgtgctggtattttgacctcttcccatgaatcacaaacattcttaatatcattggaatggggaattctttccaaagggttttgttttaccttgtctagctagatccatcaatggactcactctccatgcagcaatagccttatgaaacatatttcttaaataacaataattgaaagtcaaaagtttttcgtgtttcttgggctgcagaatggatgttgtgttaacaagcatgaaaacattaatctcctagtagatctctgtcagagctcttgtgtgaccaggtacattgttaaagagcagcaatatttagaaaggaatctttttctgagcagtacgtctcaacagtggccttaaaatattcagtaaaccatgctataaagagatgtgctatcttcccggctttgttgttccattgatggagcatagttgatttagcagaattcttaaggatcctgggatttttgtaatggtagatgagcactggcttcaacttaaaatcctgagttgcattagcccctaagaagagagtcagcctgtcttctgaagctttaaagctagtcattgacttcttttctctagctatgaaaatcctagatggtatcgtcttctaatacaaggctgctttgtttacactcaatatctgccttttagtgtagccaccttcgtcactgatcttagctagatcttctggataacttgctgtagctttccatcatcacttgctgctttaccttgcccttttatgttacgcagatggcttttttttttttttcttaaaccctatgaactgacatctggtatcttcaaatttatcttctgcagcttccttacttctctctaccttcagagagttaggctttggcttaagaaaattttgcggctgctttggtcttttacccaggacactctaaactttctccatatcagcaataaggctgttttcctttcttatcatttgcattcactgaaatagcacttttactatatttcaagaacttttcctttgcattcacagcttggctcactgtttagtgcaggaggcttagttttcagcctgtctcatctttaagtatacttttctcactaaggccaatgatttctagcttttgatttaaagtgatagagacatgtgactcttcctttcacttgagcacataaaggccactgtaggcttattaattggcctaatttgattattgctgtgtctcacggaatagcgaggcccaatgaaggaggtagagagatgtgggagtgaccaggccagtcagtggagcagtcagaacacacacatttattgactaattttaccacttatatggacacatatggggcccccaaacaattacaatagttacaacaaaaattactgatgacagatcaccatagcaagtacaatcatatacctagaagcctgggttattatgaaagttaccaaaatgtggcacagacaccaaaaacgagtagatgcaattggaataatgacaccaatagacctgtttaatgtcgggttgccaggaaacttcaatttttcaaaaacccagttatttgcaaaatgcaatagagcaaagtccaaagagattaggtatgcctgtgtatgacaatttcttaagtgaaacaaccaagtatcactaatatatataagtgtttcatgctgatatggagtgtatcaaatacagtatctatgaaaattctttcatataatgattctgttcttctacattttaagaacgatttccatttgttctgttggagctttgttattagtaagaactttcttggagacgagtcgtggccatattcttgcttcttaaaaatcttacttctgacatacagagaaaatgtgtgagaaggcatgttgttttaagtattagatgtaagcatattgtagttatgaagccagtgcaatgcaaaagaaacgagactagctttggagttcagatactccatgcacttgattatgtgtattacagagtttagatctgggtgcctggttagttttttgtaaatattacttttatatgccctctactcccgtacttataatgttcttcttggaaaactcaaacagatataccaattgtttttattttatttaattaatttatttattgagacagagtcttgctctgttgcccaggctggagtgcagtggcgtgattttggctcactgtaacctctgcttcccaggttcaagtgattctcctgcttcagcctcccgagtagctgggagtgcaccaccatgcccggctaaatttttgcatgtttagtagagacagggtttcatcatgttggccaggctggtctcgaactcctgacctgaggtgatctacctccttggcctgccaaagtgctgagattacaggcatcagccaccgcgcctggccaaatataccaattgtttaacccttagttagtgataaaggcagcacttgtttaggtctggcctcattacctttccttcaattattaaaaatacttcagaaaaaaagacattcatttactttgaaaattatgagaacaatttttaacaattactaccggtgttcattactgatttcaatgaatacaagatgaaaaaatcagtgcaagactaaatatgtatttttctcctctttttgtacgtgttaactatttttgaaattttcatttatacatagtaggcactttggttcagattaaattgatgaagaacagcggaatgattattctgagcaagttcatcagttttcatcattgattaggtaggagtgtaatgaaattaagatcatggtttagccgagattctattcagttatttctgtaaaatatgagctcatcttttttgtgaagtgggtaatcatttaattttagttttcaaaaacattccttagaaaagaaatagtggccatggtgtcactgatactcagtgtagagcagagtggcttcctactcattgtggattcaggccttaggcgaatatttgccatgggtttgccacttcactagcccgactgtgtggtccctgcctaggtccctggctggtttttcatcgcatttttcacccatatttactaggtggcctagagaaagtaaataaagctttgttaaatgtgaaaaaaatagttcagagcacagcagtatgtccatgttggactaattggttttaagtgcaagatctgaattataaaaataaatatagcaggaaaatatataaaacctaaataaatctcacctcatttctcctttaggatttttgaacgtaattttgcatacaaaaggagcacaaattgcatgcgaaacattttgtaaaataataactgtttttctgaaatctcttcaatatagagactaacagtatcttaccagaagcaaatcttaacagttctacacactcctatattttctcaatgtatcctgttttgccaggactctcatctctttcttctcaaaggcctgcagactgtggtcttctctgttaaagaagaccatggctgaaaggggttgagtgggtgggagtgaagatgtaggcgggaaatgcttagtctatgttttatctgtcatacatacaagtcctgatagactcatttatttatttcagttagtactaaactgaaatgtcgccaaaaacagcttaatggttcaagtaatttaatgaaagcttcagttaacaaataaatatattttaaagtgaataaagcaaaatattttagattagtcaatttaacacgtactctaaatcttgtttcttctccttttctacttaacaagaaattgttttggaaaaaatggagattcactaggtattaccacggaggtggactttagataaatgtattacattggtaaaaatcaaaatatataaaccagatatataaagaggaaaataatgttgtttcttttgtttttttttaatgagataatttgccacaagcagttttttttttttatcatacatttcacttgttctataatgttaaacatttaaaaagtttttcaggatattagaaagcaaaaaatttaaaaattcacatacacttttaaaaaagatttagttactttactaaatagaagtgtgttgctattggaatagaaaattcaaaaacatttaactttacacaatagtgaaatctaataacaatagcataaaaaagagaaatatattagtaactttttatctccaattgaaatgaaaactcagcttcattaacctttatggttattagtggtttatcccattacactattttttctaatcaattaacattagagtccaccacaatgaattacgatcttatgagtttattggaccggctttttgagaattccctaataacatgcaaaatgtcaatataaatgtttggtgaaatatgatactgtttgtggatttttaactagccacagtactaattagactgcaatgcattgaactttaattgtggggcttgattgatttaataaggctaacatctgctgctttccctagacttagcatcaaggtcctacatatcaaggtcttattaccgtgctgaggctgggttatgagagtgaaataccatgagaaatgtcaatgcagatggcatatgttgcaggcatagcaaaacacccaagtgcctatattcattcctctagtcgcagaataaatggggaaagtttaaagaccatgagcacatgtttaactgagcaacaaaacttcttgagaattctcaaccaactattactttcgtcgattttcctgctcttaagtttgacccttttcagtaacatgatatgggaccaaagtatcgatgaaacagtgtctacagttaggaatatctgagtttcattccagcactgtcctcaatatataagccataaaatcatctactttcaagaatgttattctggatgtgtgtcattccaatagatatgtttatattgaatcctactctctgatgaaattagaactgaagtcacaaaattattgttttctcctttcccccatttctacatctaaatcaatactattttaattttttaaaaagtcctttttagattctacagctacaattgggttctgtgatcttttttttttttctgtttcttttcctacaatgtctgacaaccaaaatcacttctccctttgcaactctgccttaaagatagcccagtcctctgcttgaataggaagtcccattgcccacttaatattccttagtggggtcttaggtgctccttgctcaccttgtttcctctggtgtggattgagattaaagccttgtaatgctgtccttcttctaaactatagtccttttgttgtttgtttgtttgttttttagaactatacaaggtgaaaagacatcctgaggcacttttctctgtctctaactcttggcgcaatgatttgaggcaattcatggcactgactgctgcctgacctccctccacaagaagtttgttaaacaaatttactgtaattcaatgaaattggagaaagtatgagcttttatgccttttaaaaatgctccaatctgatgaattgtcaggaggtttaaaagccatggattgaaagatttttttttccacaatacccagaatgggtaaaagaatgaatgtgacattcaaatagaagcctgagaaatgagggagggagagagagtggcccttttctgctgacttctagttcttaaatattttatttgaaaatttcacaataccatttattaacaattcaaaatgcagagcgttctgagaaactaacaaaatgtattatcattctccgaacctcatttatttagtgtcttcctaaatggatatgaggggaagatgctttaaaagatgcagacgatgtttagctgaaattatctatggttaccctgcaatatcggcctaggctttaatgatatatgtaaagaaagatgtcacatttttaaaactttatctcagcgatcataccgcagttaagattttccctgtggaaattagcactatggctagttaacacctttaaataagatgatattccacagggcgtttttgctgatgtattttaggtttttaagaatcctagcaacaattgaaccattgtaaattatttttctgtgacatttgttaggttttaaaactagactaaaatgtaagttaactattaagatatctattactttattttgttttaagtgcaaatttataagaaatcttgacccttgtacatgttagaaatgcttgttccctggtgccgtaaagaagtagcacttgaacataaatttaatttcctcacaaggccatttttttcctttctgcagaaagggtacacttgccagcagttttgccatgacagtacaccgaacaaaggagacagggtcacttataacctgacacggccaccctactgctgtgtcccgtttcctttggctggaacgggacctcagattctgtatttgtcccgattggctagcaacttagaacttttgaaaagaggcaaaggcagaggagaacaaaggaaggaggaagtaacttgtggaatggtgagaaaggtaaaaagaccttcaaataaggaagaagaacaggctttgacctaatgcttgcttggaccagtataagcatgccagggctaagttgtgtgagctaagaacataaaatacattgatttctttattatggctggcagatatttaagagtgttagcacaggtctttgaataaagtttgcttctaagagaagttactatttattcctaattagatggggaggaaagtctttgaagaaggacctctactttacttgtcacgtatagaatcatcatctaatagatacggcaagtataactgatgttctcactggaatagagcttatttacaatggtagggtactgcttttgtaggttttcccagtaccaaataaagataatcttccaaggaagaaaaacatgcctaggtaacacataccccctctcagagacatctttatataaaccagtgtaagaagaaaaccttgcattaacaataaaatagtttttaaaaatttaatcatataggctgtgcacagtgtctcacatgaggcctgtaatcccagcgctttgggaggctgaggcaggtagatcacctgaggtcaggggttggagatgagcgggaccaatatggtgaaaccgcgtctctactaaaaacacaaaaattagccaggcatggtggcatgtgcctgtagtcccagctactcaggaggctgagacaggagaattgcttgtatccaggaggctgaggttgcagtgagccgagattgtgccaatgcactccagcctgggagacagagtgaaactccatctcaaaaaaaaaaaatagtatttttattcatacaaatatgttttgaaacaatatactcttccttttaaagacaaaataatgcagccacatttattttttatcttataacatgaaatcattccatcagaatagacagacaacccagttcctgccaatggacgttgactttgaatttcaatatgcagattgcagagtccttcagagacagcacctgtagctgatttgttctgtcccctccagcttttggacccacttctcatgtggggaaggttgaaattacattgtcacccttggctgtgaacattcacgaactttttcaaataatgtctagtattaaaaattatgtatgcagtttgtacctggaagatgagtttttaatttcagcattgagtttctcattgagggaatgtagggggaaaatcatcctgtccatatgtgtatatggacaaacacctcctttatgtaagagaaaccatgtgcagaggcaagagctttcctcagccttgcactcttgttaagtgtatccttccagagggggcagtagaaagcatcttgcttatgtgcagagtttcatctctcctcactccaagtctttctttattctctgtgcttttaattttctgcaattagtagatggcaatgctgatggccctgagagttacagggaaaccaaaaatcggtaagatttcttatacaatgacaaccaattgttttagcacacaaaaccacagcattcattttattgcaggttgataaaataattccaggtatacgaaaagaaagatcactgataagcaacagtggaaagctccatgacatttctcctacccttgtatagtgacagcatgacctggggtaggtggaatcgctgggaatgcatagaactggcccgggggtgggcggggtgggtgggatctggaccacctttgatttcagaatgggttcaaaagtattcacgtatattaagaaatagcatagatccaaagagcaggagcaatttaaaaaaaaatctataccttctttaaaccatttttattgtcatgtatactcttattacttccttctccttcttatgacatcatctattatattggtggatggaactacttgtagatctgaacttagtacagtaccgaagcctacaaacggccgtgaaacctgtgaatgcagctgggcagtgccccctgttccacttaactgcatttttatttctacaaaaagattgaattaattcagcagttactggtttttgaaaagttaggactcattgcttgtgctgatatttcactgctacctacacatttttttatgcactttaaaaagggcaatatatcatttgtttaccactcagtcctggcaattaaaagaaaaatacattcaagaagttgaataatcaatgtaacatttatatcacagcatatgtaattatgaggctgtattaattatacctactatttctattttcctttcagtattattacattaacatcattctcatgttcttttctgagctgcttcattgaaatgtaaatgtccaacaggcaattaaatctatagatagtttatttacctttgtatgtcctttatactttcataaactcaggcctccttgaataaagtggggaaatttaagaaaaaaattgatgctataattgttcatcaattagaaaagataatattttaaaaccatcatattcttcaatataaaaattatgttaaatgaacttaagaaattaacagataatctaacaaaacaaagaatttgatgtaaaatgattttttaggtaaccttcgactctcatattaagaatgtttatgaaactattttataaaaaagtatctgccaaacatcactgagagacatatttttaaatttaaaactaaaatatttggtagatttggtatttttcttagtgttctgcttatacgcaatcaaattagcatcttcttttttttctgcttaacaaaggtaaagaaaatattaattgttttcttttcttttctattttgagatgaagtttcacttgtttcactctttcgccgagtgtggagttcagtggcgtgatgtcggctcactgcaacctccgccttccagtttcaagcgattctcctgcctcagcctctctagtagctgggattacagtgatgcaccaccacggctggctaatttttgtatttttagtagagatggggtctcaccatgttggccagggtggtcccaaactcctgaccttgtgatccacctgcctcggcaccacaaagtgttgggaccacaggtaggagccactgtgtctggctgtattgttttctgttatacagtgatacctttcctttttccattgaatactcataaagttcttataaagtcagaataattttcatgctgtctggcaccttaataattattagcttatgtctgctatatatttatttgtaattgttggaataatataaagaaggttagcatttatttattagaagctgttagatataatatctctaataaattatagcttcaaaactttatgacaaccctatcttttatttataataatttatattattctcagttaaaaacgataataatacctaaagataattacaataaatactaaattacctcttataaaaacataaagcacaaaaagtacttttaaagatgccaatttggccgggcacggtggctcacgcctgtaatcctagcactttgggaggccgaggtgggtggatcacgatgtcaggagtttgagaccatcctggccaacatggtgaaaccctttctctactaaaaatacaaaacttagctgggtgtcgtggcacatgcctgtaatcccagctacttgggagtctgaggcaggggaattgcttgaacccgggaggcagaggttgcagtgagctgagatcacgacactgcattccaccctggctacagagcgggactccataaaaaaaaaaaaaaaaaaaaaaaggtgtcaatttaacttgaatttaattgcgttttcaaatgtgtttcacataaaagtataggtcaattaattgtttctaataatatgcttttcataaaatcatattttaaacaactgataaaattaaccagaaataaatgttagaataatcatcaaaaattaaatcaaaaaagaaacaattatttgctttttgtaagtgaaaaataataaagaatttagtattaaaatactaatgaaatgcaacacatgtattcactcattcaacaaatatttataacagactctatattagctactggtaatatctcaacaaaagacagaaaaaatcttactgccctcctgtttctggtgaaaaaacataaaataagataagataaaataaatagtgtgtaatagattgaaaagttataaggagaaatacatggcacaaggggagtattggttagagaggacatggattgtgattttaccattaacacataaaagaggaaataaatcaacatacgttattagtacttaaaatcatgtctgggaaaaatatgacttagaaagtatacataaacccccacctatacacaccacaagtgtgtgtgtgtgtgtgtgtgtgtgtgtgtgtgtgtgtgtgtgtgtgtgtatggtgtttgtgtgtgtgtgtgtgtgtgtatatggtgtttgtgtgtgtgtgtgtgtgtgtgtgtgtgtatagacaaatagacaattagtttcatagggtaaattgggtgactgaggttaaaggtataaggaaaagcctttactgcttggctgctgtaccttctacattttgttatgcagatagtatatatttaaaaaataaaacttgaataaaataaattaataaaggtccccaaatatctttcactgcccgtattagttggttttaatgctgctgataaagacatacccaaaactgggaataaaaagaggttcaatgggacttacagttccacatggctggggaggcctcagaatcatggcgggaggtaacaggcacttcttacgtggtggtggcaagagaaaaatgaggaggaggcaaaagtggaaacctctgataagcccatcagatctcatgagacttattcactgttgcgagaatagtaggggaaagactggtctccacgattcagttacctcaccgtgggtccctctcacaacacctgggaattctggaagttttgagtggggacccagccaaaccgcatcagtgtcttaccacccagcattatgaacgttatcttttgaactgtatttcaggtttaactgtataatttaaatattatttctttcatcatgcttttatattttaaagtacacttaatattaaattgtcatttgaatatttctaattaaaataggatagcatataatatataaatgcacaagtactttactctgatgcttcacctcttgggttattgtagcaatcgctgaagcacattccccaaatgcattacttataggtcgctgtaaagcaaaatagcccaaaatgtagcaaattgaaaacacacacatttcttttctcataatttctatgggtcaggatttgggaagtggattagctgggtggctctgcctcaggctctctttactgactggtaagaaagaataagagaagtggggcaggcatagccatagaacagatgcagagacccacagtatctctaggcaggataactatttaaagtctttctcttaccagtcagcaaggactaaagaaatactgcttcaaatgctaagaaagcaatgcagaacttcaaggaagagagaaaaaaataaaggaaatataatggtaccaaaatagcaaaacaaagcaccagtaccaaaccctaaagaaatgagaatttttgaaccgcctgacaaaaaaattaaaattatcatcttaacttcagtgacttacaggataacacgaatagagagttgaagagtaccagaaaaacaagatatgaacaaaatgagtagttcaacaaagaggtgaacattataaatatgaaacaaagaaaatctggagctaaagagaacaatgattacactgaaaaaattaaagaagtgtttaaacagcagactcaaccaatcagaaaatagaattagtgaaatataagacagatcatttaaaattatccagtcacagggacaaaactgatacacaattttcaaaaatgaagcaagtccaccgagcttctgggaaaccatcaagtgaatcaatatatgtatcatagaagtctcagaagaaacagagaaagataaatttcttagaggaataatgacaaaagctttccaaatctggagagggaaatgaatgtctaggtatatgaagcccaatgaattaaatgcagcttgagcttttagtgattctcattgagacactttaaactgtcaaaagtcatagacaagaaggaatattgaaagcatcaagaggaaagcagtttacaacatataaggtatccctacaagaacatcagcatctttctgaagaccaggaaaaaatggatcgatatatccaaagttatgaaagtaaagagctgccaacgaagaatgctatactcagagaaactgtccttcataaatggagagatacagattttcccgcatcaacaagagctgagaaatttcatcaccaccagatataccctgcaagaaacgctaaagggagtccttcaaattgaaatgaaaggacacttattagcagcaagaaagcacaaaacttacctgtaaaggtaagtgtatagtcaaattcagaatattctaatactgtaataatggtgaaaaatctaactcttttatgaaatttaaaggacaatatattttaaaaatagctacaagcaaagaaagacaaatactgcatgatttcacttatctatggaatgtaaaaaattgaaactcagacgcagggagtagaacagtggtaactatgagcttggtgaaaaggtgaaaatgaggagatgtttgtcaaagggtataaagtttcagtgagacaggaagcataagaactagagatttattgtacagcatggtgactacagataaaaagaatgtattatatatttgaaaatttctaagagagtagagttaaaattactgaaccacaaaaatggtgagtatatgaggtgatgagtatgttaattagcttcatttaattatttcacagtgtatcctgttctgtgtgggaaatgcgcaaggtgagaataaaagacacacacacaatacctttaagggtaaacatgtcccacataaatggcaatgcagatataataagcaaatgatccaataagcaaattaatataatcaaattgacaaaataagcaaatgatataataaggaaattgcaatgggaaggggacaagcgaaaaaaatatacgtatgtggatgtatgtgtatatatacatacataaactccccaaatggggaagggacagcctgggctccagagtcagacactccactcaccagactctggaagattcaccaccagacaaggaaacaatagcctgagctccagagtcagccactcattagtgcactgatgaggagaggtctcatgaagcttcggcgtggtctgggaccctagctctcttttaatgagttgtttggcatgagtcccagtcacaagggcccttcgcaactgggctccaggaacacaaaagggtcaacttgtttttgcaattgtctgttgtttttcaataactaacatataagaatagatggaaatagagatttctctgaaacagccctggatgaacacctcaaggggctcacacaatctgtttcggtatttgttgaccattatttgtgttcatgttcagttgagttgaaatttaatatttaacttttcctccacatatcccaatatctgaaggccatgttgtacaccatgaatatatagaattttatattcatcaattaaaaagttttaaaagtacagacaaatgtactaaaaataaccatacctacaataattggttaataaatacaaaatataaaaaagatgtagatagtaatatcaacaacataaaatacagatttggatgaaaagcacaattaaaagttatttttatgtgaccaaatttacatttttatcagccacaaaatagactgctttaaccagaagatgttttatttaatcctacttgtaaccatgaacaaaaatcaaaaactctagtaggtatacaaaaaataaatagaaaagaatcaaagcctatgaatacaaaaattatcaaattatgaaagaaaatgtgacgagaaacagaacagaatatattaatgatgaaacagtccaagaagtttaataacatggcagtagtaagttcttacctattaataattactttatgtgtaagttacttaatttttttttaatccaaagacagagtgactgaattgacataaataagatccaactatatgctttttaaaaggaactcactatgtttttaagagcacacataggttgaaagtaaagagatagaaaaggatatttttatgcaagtggttaaaaagaagagagtagggttgtctatatttttataatacaaaatagacattaggcaaaaacggaaacatgaaagaaagaatgtcataatataatgataaaggggtcaattcatgaaaactatataaaattatatatgcacccaacattgtagcacctacatatatagcaaatattaacagaactggagggaaaatagaaaacaatatattaacagtatggaactttaatgcactgctttccaaaatagacatgtcatccagacatcaaatcaataagaaagcaatgtacttggccaacagtatggaccagatggacctaacagacacatgcagaaccttccagaccacagcagcagcatatacatttttctaagctttgcacaaaactctctccaggatagatcatatgttaggccataaaacaactcttaacaaatcaaagaagattgcactcatatttggtaactttcctgactcttatattatgaaactaaaatcagggagaggaggaaaattagtttacaaatatgtgaaaattaagcaacatacgcctgaacaactaatgggggaaggaagaaatcaaaagggaaatccaaaaatagatggaaataaatgaaaatggaaaccaagcacaccaaaatagatgaagcaaaagtggttctaagagggaagtttacagaaatgatggcctacatgaaaaaaataaaaagtattttatataagcaacctaactttacacctcactgaactaggaaaagaacaaaccaagctcaaagttaatagaagaaagaaaataatacaagttagataataaattaaatagaggctagaaagacaatttaaagaaaaatgaaaaatactgaaattttatgaaaggatagacaaaaatgataaactcttatgctaagtagaaaagagaagactcaaaattagaaatgaaagaggtgatactacaacaggtattacagaaatataaatacaatactgtaaaaattatatacgcaaaatgtggataacctaccaagatgaatcgtaaataaacagaaaatctcaaagggtcaatacaaataagggaaatgtgtcagtgttcaaccttctttcaaagaaaacccataaatagataccttcactactaaattttatcgaacatttaaagaaacactaaaccaacgcttttcaaactctttcggaaacctgaagaagaggaaacattttcaaacttattttatgaggccagcagtaccctcatgtcatatctagattacattacaataaaagaaatgtacaggccaatgtctgtaatcaaaatagatgcaaaaattctcaacaaaacactagcaaaatgaattcaatagcacattaaagggatcatacaccacagtcaggtgagatttatcgctgggatgcaaggttgttttaacatacgcaaatcaataaattggatataccccactaacaaaatatgatatttataggatcatctcaatagatgcacaaaaaagcatttgacaaaatttaacctattttcctgataaaagctctcaacaaattatgtgttgaaggaatatacttcaacataataaaggtcatatatgacaagcccataactaatgtacataatgatgaaaagctgaaagcatttctctttaaatttaagaacaagacaagttgcctactcgtgccaaacgtacttaatatagtactgaaagtcctagccagatcaattaggaaagtaaaagaataaaaggcactcaaattggaaagtaagaagtaaaattttatgttttcagatgttacagtcttagaaaagaacctacagtgtccacacacacataaacacacacacacacaaacacacacgcatcttagaaaaatagggcacgtacggtggctcactcctataatctcagcactttgggaggttgaagtgggtggatcacttgagcccaggagttcaagagcatcccgggcaacatggtgagaccctgtctttactaaaaatatgaaaagttagccagatatgctggcacacacctgtagtcccagcttctcagaagactaaggcaggaagatcacctgagtgtggaaagtcatgacttcagtgagctatgattgcaccactgcagtctagccagggcagaaggagtgagatcttgtcttggggaagaaaaacaaaaaagtaaaaaacaaatttggtaaatcctaaagtaaaaaaaaatttggtatattcacagattacacactaaaaatacaagactcagttgtgtttctgagtcaaattatctgataaagaaattcccaaaaaaatctcattttgaatgtcattaaaaagaatgaaatacttggggaaaaaataaccaaggaggtgaatgatctgtacactgaaaattatacaatatttatgaagaaaattgaaaacacaaacaaatggaaagatagcttgtgttcctggattggaataattaatatttttaaaatgtccatactacgcaaagtcatctacagattcaaagcaatctctatcaaaattccaatggcatttttacagaaatagaaaaaaaagtcataaaatttgtatggaatcacaaaagaccagagataaccaaagcaatcttgagcaagaataacacagctgaaggcatcacatgtcctgatatcaaattatattaccaatcttcagtaataaaagcagtatgatactgtaataaaaacagacacatagaccaataatacagaatagaaagccagaaagtgaactcaagcaaaaactgccaactaaccaaaaaacatgccaaaaagacacaatgggggaaaagagagtctcttcaacacatgagattgagacaactgagtatgtcgtgcagaggaatgaaactggcccacgtgttagaccacacaaaattgatgaaggacttcagtgcgatacccaaacccgcaaaactcctagaagaaaacattttttaaaaatccttggcatagatcttgacaatgatttctttcttttttttttttttttttttttttttggatatgacacgaaaagtacaggcaaccaaatcaaaagaagtgggactacgtcaaacacagaatcttctgcacagcaaaagaaacaatctgcaaaatgaaaaatcaccctatggaatgggagaaaatttttacaaccacatattttttaaaaatatttccataggtgtttctggagcaggtggtatttggttacatgaataagttttttagtggtgatttgtgagattttgatgtacccatcacccgagcagcccacactgaacccagtttgtagtcttttatccttcacccccttcctattctttccccacaagtccccaaagtccattgtgtcattctaattatctttgcatcctcatagtttggctcccatttatgaatgagaacataaaatgtttggttttccattgctgagttacttcacttagaagaatagtctctaataccatccaggttgctgcaaatgccattaattcattcctttttatggctcagtagtattccatcatataaacatatacctcagcttctttatccactcgtttttgatgggaatttatgctggttccacattgcaaaccacgtattcaataaggggttaatgtccaaaatatataagaaatgcatatacttcaatagaaaacaaattaaaaattaaaaatgggcaaataacccaagtagatatatctgcaaagacatacaaacgtccaacaggtatataaaaaggtgatcaatataattaattatcagacaaacgcaaatcaaaaccacaagaatatatcacgtgatatttgttaagatggccattatataaaaatatatgtgttgatgcggacgtggggagtaaggaactctgtacactggtggtaggaatgtaaattggctcagtccttatgaaaagagtttgtaggctgctaaaaacaacaacaacaacaacaaaacctaccatatgacccagcaatccccacttccaggtaattatccaaaggaatatgaaatcaggattttgaacacacactttcactcccatgtttactggagcagtattagcaattgccaggattaggaaacaacataaatgcactttgatcaatgagtggaggaagaaaaagtggaatatacaatgaaatattactcaccccttaaaaaagaaggaaattgtgccatttgcaacagcatgcgtgaatcgggaagacatcgtggtaaatgaaataaaccagcttaaattttaaacatttaaaattagattttaaatgcttaaaaaacacactgagaactttaaattttcatttaaaatttaagtaaaattttaaaggcctaaaatttctaagcatgtagatcttatgtgcttttaccgcatacacacaactaatattgctaatggcaaaactaataataggtgtggggggaatctttggcaggtggtagatttgtctgtggccttgagagtggtgacggtttcttggatatatacgtatctccaaaacaatctagttcatggcattacatgtgtacaactttttgcatgttagtcgtaccataataagcatttttaagaaaaaggtaaaatataaatatgaagccaatctgaactttatgtcaactagttgcaaatattttgcagtttcaaaaaaggcattccaggtaataaaacattggttgttatttgtgtattttttatgtttatcttttaacaaaactttcagccatagtagcaggaaacatatttgtgcgcgcatgagcgtgtgtgtgtgtgtgtgtgtgtgtttcgtggtataaccaaacccaaactcctgtagagggaagcagtgcggtgaagtgtcaaagtgagtggactgtatatttgcaaaacttagcattcactcctgagtctgctactcccaacgcatcacctaatttcaggaacttcagttcgttcatgcattcaacagcatctcatagggttgcatttcaaccacaggaaatggctcatgggaaacacttagctgagattaagcgctccataaatatttgtaatcgttattcctctgtgcagcaggtaagcactcattctcttagactatcttttatgacaaagattttaaaattctgaataaatgcctggtgtcttaagaaacatattatgtaacattcaaaaagaggaagaaaataaaatcaatttccagtatcaacaatgcttcatagggcagtggagtttcaccattttgcctcaggaaataataaattggaggagaaggagcagcttttagtgcagattattattgttattttttttaatatgtctcattctgtttcatgaccagctagggacttttatttggtgcaagtccttatctctctaacctgcagcaatctaagaccaccccccataatccatcttcacagccttattttgaaattgagccactcaattattttttctctctctagttttgtgacacattctcaatgattatctctactttttctatccttgtgatgactgtagtaggaaactacacagattacatcaggtgatgaatacatccgggttgcctgtcagggtacctatatgttaagtacatttgcagtcgcctactaaagttcatattgtcacctacataatgttcatacaatcatacttcatacataatcggatactaaatgtttcaacctaggcgtatccctaagtaggaagttaattcccatttatcagaaatttcaagctaacaagcctttatgtataagtaatgtcatggttcatataagtgttttgtcatttgttaagacagttttagaaattgagagttatttcatcatggaattacctcctatgtacagaggcttgatattcgctgacaatattcatgctatataaatatccggcgtagtgctgagaaccaggtgattttatatgagactttccacaaaagctttctgggctcctgttgtatatattttcgttacacctcataaatgaccggttggcaacatctggaagtctctacttcatcattgtattgttgtcttcaatttcttgaagtaatagagcatttagcattttttttcactgaaatttactggcatgttatcttttttgacagaatcattgagtcaaagacttccagagcagacactttgaaaagcaaagtattatgttacccatttgtcttgtgtctgcagtgacattttccaactaattgcattatatcaatcttatgaatctcactcaaatgcttccagtccgtttacctaaagtttggagccagtttatgtaggtctgcctcagataactcacacaatttatatgattttaatttccttgttattcaaaaacaattgaaaagtttctagttggggtgatatgtaaaatgttaaaccccaaaatgcatactagataaaggtaataaaattgatacgaaaattttaggaacagatgcaatggaaagcgagagagttcataatttgagctgctagctaaattaacattcaaccaataaattataacagagatagagttctacattattagtaatatcagttatgaagtacacaggttctgttaaattatatataattatatgataagcttttcaagtatttcagtaataatcccattaaatgtctgactattatagaattattcatccttgtgtttaaagctagaatttgatcgtatgatcaacaaagcccagtaatgtcctgtttcatgtcatcctttcctgcacttccctgaagtccttgaagtgatcttccgaacctactatgctaaactctttttttttttttttttttttttgagacagagtcttactgtgacgcctaggctggagtgcagtggcactatctaagctcactgcaacttccgcttcctgggttcaaatgattctcctgccttagactcctgaatagctgagactacaggcacacactaccatgcccagataatttttctatttttggtagaggcagagtttcgtgatgttggccaggctggtctcgaaatcctgaccttaggtggtcctcctgcctcagcctcccaaagggctgggattacaggcgtgaactactactcccaacctgctacctaaactcttgactcttcattattagggcttttccgatccctaattaattcaataactattccctgcctgtatccctggatgtgtttgtagaatctcctcatcctgaacacttgtatgtgtgtgaaggctgttccgttcagctttcatcacactgcaatactgttttgttgttgtcgttgttgttgtgtttagttcaatcagtaattattgagttattctgtaagatttcagcagcataaaactgaaaactgtatgatgtgtgccttggaagtatttgcattctagcataaggacactcagtagagtagatgtcaataaatctttgttgaggaattaaccggtaaaaatgaagaatgagcaaagacagatacatgtcaaaggatctgaaaaaaaaagggatagtcaaaaaataaagacatctttcaacttgacaaccaagctgacttaatgcatactaacgtggactaggtggagatctgagagacagaaagagtttcatttaatgctagctggtactattttcttaatttattttattttaaggagtaaactgccatttcaacagtggaaactattgatactttagttaggagctacaaaaattaaactttacacagattgcacacacactgtccttactcaaaacatgatataataataattagcgttagaaatagaagatttagaacatggttgtctctcctttcttgcaccaaacatctttatctgtacccgtatgtttttacatctatccaacgtaatgggacacatcctgataccctctaggccccattctcttcctcgttcttaaaaaccatgagctacctgtgaccctttctctccaaagtatgcaacctctctaactagctcttatctactctattctagcccttttgcaggtgctcaagttacttacctctttttgggggttaaaagtactttttcttgttttctctgactgaattatttttctcatcatactctattcatataaaattctaacgctgaagacaaggcacttacataattcaaatatgactctttattgtgatcatttccacttaatattactttttctttaacttagaagtatagagaagggtttcaagaataacaaagtattacaaaatttaaatattggctaaagtactttcctttatctgaagtcaaaagtgatcgttaatttatttgagtccaaaactggactttatacagctggacaaaaaacagtcgaggtaatcataaattatatatacacacacaggaaagtcaaggtgattagaccgtctgagttggttctaatactctagtactctggtgcccagcattaagatacaagttgtttatctctttaagaactcatcctgtgacccacattccttccccactcctgccttccctgcatgcttccatctaaacttcctgaaagtttgcatccttgatatttcgatggccctgacccaaatgtctcaatgctggatgactccaccacttccctaagtacattcttgccagatctgtgggcaaatgcactggaactcactgaccgtattctttgttgccttattattacttgcacctagggctcgctccatcctttctgaaacacatttttgttcacttctgggacacattccaagggcttgcttcttccagtctggaggttacatttcccttcgctggttgcttctgggacacatcccagtggtttgcttcttctggtctggaagttgcatttccctttgtgcttgttgcttcctctgttctgatatcggattggccttggattctcactcctgagcaggtcgatggtcctcacaggatcctttgacaaaaacctccccatggcttccattgtcattctcgtgccaaggattcctgaatgtttattccaaccctgatatctgttctgacctccaaccaatatattcggttctcaactcaacatctccctgtcgatgtaacatggatacttcaaatttcaaggtgccaaaaccccacatgaccactgcaacacagacacacaccatccaaaagctcctttcctagtgctgccatgttgccctgctgctaaagtcacgattctctccacgccttagctcattatagtcaccagtgcgtaggctttcctgtgtcttcctcacatttggttactcctctcaatccatgttcacaccctgtgttctcttacctgaatgaccaccatagctgctgattaattgatcttcattcactcttacatcaccatcactactacgccccctccagaactctcaacagaatataatttaaatcataaaatcctaccatgtttactctagctagcattgcatgccttcgtgtgaccttgagctacaagagcagactgcagtctgcctcttcaggctcatcttggacatttcatcccatcagttgtcgtattctgcatgtatttctcagtttatcaaacatgctccacttttttccacttgaggacgcttgtaaacactgggtgcaattcaccttagctccttctctctcttttctatcatgcttcaactttcatctccaaaaccaccttggcagagaagctaagattaaccagccccctctgttatgtatttccattgtatgcaatatgtttcacttgagggtctaggagcacgcagcctctctggtttaggaatgtcttccctggtctactctaagtagaaatcgtcccaccctatttgtccctgcacccaaattggctagaagattgccttgaatgtagtaaatcctaaatacatgttttgactgaaaccagattgattagtacgtatcaaatatcactaaaatataaaatattcaccctccgtatattgttttttgaataattagtgatatttcccagtaagttcatgcccctatagaagtatgtcgaatcagagttagaaaacgatttctctgaaatcattacaaattcatgagaaatgtgaagttcccattaatcaggttaaataaaaatagaaaatcagtctcagaattggacaagctgttatatttattgatttagggtttgaaaagactcagtcaaatataaaaggtggttaaagaaaatatactccatatgtgtctatatgacaattggtgatcctttgaactatttttatcggttcaggaaacttgtgggaagatgtaagattcaggtggacatatagggaaaacacatagaggagaatcctttggaaaatgatggtgagaaaagataacggaggtaagaagatggaacacagatgggaaggagaatcttttgtttgtggcagtctaagaaaatgagtttaattagacagaatttacaagtttcagtctattgagaaatgaggctggtgagatgagagatttctgatggaaaagtcttagaataaaggaggaagttctggagtttgataggcgagcctgggagtgcttatggcagctccgacaagcaatgacatgtgaaagaggtgattatgaaagccactcctagttattaatcgaattggatggcagagaaactggaaatataaagaccagctggtgttatatagccttcgttttcttcttcttcttttttttttttttttattttgagacggagtcttgctctgttgcccaggctggagtgcagtggcgcaatcttggctcactgcaggctccgcctcgcgggttcacgccattctcctgcctcagcctcccgagtaactgggatcacaggcgcccgccaccatacccagctaattttttgtatttttagtagagatggggtttcagtgtgttagctaggatatatagcctttcaataaggaaaaaaaaaaggatctatgattatagagacttcagttaaacaaaagaaaaatgacctaaagaatgatgtgatttgattttggaatgagcattcaagagagatgctgacatctagtccccagagacccgtctggaagcagacacttgcattatatgattttctgagagctctttgagtcctgtgattggcaacctgtccagtaaaccacagctgccaaggtgatttgacagaattttctggtcatctccaatttctagagttctggagtgtccccagagggctagctgggcagcccctgaataagtaggacttggccacatctgtcttgtaatagctacagaaatatgcccaagaaagcgttcctggtcgtgatcaatcaagctaataacagttctgtgtagatactgtgtaggaagcacttatttttccagttctcttgaaattcattgcatccaaggaaggcagaaataagatagagatttggcctgtagcatgcactctccaataacaagttatatttgtaataatgtactctggagagaaggcactacaatctctaaagaagcaccgaattcgttgtgtttttatatccttaatggtctgaagaagcatatgcaaatacaaaggggaaaatagattatagatttagcaatatcagtctgttttcttattaagcacaatagctttatattaaaatcatctgtcttttgctgtgttagaacccaaaaataatgcattcataatactgtctgctcaagttattctgaaggcaccatttgaatctgacttctttgtaaaatttgtataatgtttacttggttcactttcaaaatataaagtgaacaaaataaaacctgaacacttaaatttcgtgattttatgaagggattaagcgtcttgacggcagacagggcagcatcttcagagtctcttcctggtgcattctgtggcctcggtgcacctgccaccctgtcgtcagtttgcaggacacaggcatgctctgaattccatcatattttcaaacgtggtgagagagctgagcagctgggaaacgcctctgacatattttcctccccaccccacaattcactgaactgcatgaacattgttttccgtgcattataaaattccttgtcccccgatgtaacatgtgtccgacataagttgtaagaaaagctcacacactgttattatccacagttgatgttccgttctcctttccccaatgccatgttagcagctggtctttgctctagtgatgcctctgttttaagagaaaaataaagaattatttacctttatttataaataaatggaggaacattctagttactcccaagtgttgtctgcatatcagtcaaaaagccattttttcttccttgtctaattagagtccaagcagctttaatacagggcttagtcttttaacgattttgtacccattccatcaacttgtatacagcaggacatacgtggtgcttctattacaatcaccatgcaaaattgtgatgagaattattaaacacttttcaaatttgtcgagttcgtattagctccagagtcaagacccccttccctaaacttttgcctttgctacacaagccgcaagaatttcgaaggaggaatgatgatgttaggaaaaggagggttcccaggtgactcttcacccattcctgcagcacaaacaagctcctgagcctaacagagggccttattagaagttttccctctatgccacgaaaaggcacccacctccctagggttgaaatacctggggagagcgaccacgctgtgggaacattcctgcttctgggagaaagctctctggatatttccgcactgctgtctcaggagcacgccgtgtgttctgcctttttctgcgtatcctgccctcggcacccttgagctcatttttcctgtagatttggtctgggttcctcctgacgaatgtgagtcagactggcatttcccagcaaggatgcccacacgaatcaccctaggagaagtaaaagttacagacttcaatgagggaaagtgcctcaacactgacaccttttgggtctacatctcctccaagccaggacgaggttgagaggataactgtctcagcctgtcacatccacaaatcttagctacagcctgacccagtctccaaaggaccaatcacgatccacttcaagcctctccagaatattgctttagttgtctccagcccagtggacttgttcactagaattctccaaaggccttctcagctgctccccgcatttcacccacaatgtgaaaaagaaaggcaagcctcctacagtagtgaaggagaacactgtagtagtgaagtagtagtgaaggagaacagtagtgaaggagccctgtttgccagcgcttgcaaagcaagatagatgcatgagtgatcttcctcttagggaaggtgtgttattatattacctcacagtaacatttgagaagtcaaaatgtcgttggtcctcacatagagatcctgtttcaaataatagctaagaatccagaattgcccctaatgcctgtaagccagtttggtgcctttggaaggtatattaataatatctttgagacctctggcctgctattaagcgattgcttcaccagagttgtttcatgttattggagtaggccctgcagagcaattacaaaaaataagacagatttttttttaagcaatgttcttaaaagtatgttccagggattaaacaagggagaggcaaatgtgagctccatagctacaaaagtgtttcccttaggttaggagtttttttgttttgttttgttttgtttttttaccaggggatactggatgtgtaaaggcccagggaatgtgtgtgcaccgaaaatctgcgagcaaagttttgtgcttacattcccacagaatgctgatgcaaatttatcagattcccattgggaaaatgtatccataatgattaatagcataaaatattcagtaaaaattttgttgaaatcttcacatttcctttcatgatatatgcgatgttgggaagatttcttgatgaacctgactcagctttctcatatctcctaaaattgttatgcaaattaaatttgataatgactattatgtgcttagtatctagcctggcccatggtcattgatgcataaatgcaggtttatagtgattgccatgtatttgttattctcagaggggctccataaagcctcaacagacattagggctttgacctccagtgactgcaatttgagagtcagactttggggtcaaatacctatggagtcctcctggtagaaagaggaaactgtgaacatatcagagcacatttctggccccagcaaattaccactctccccacaccccccaaaaaaatcaatcagtgaatgcatgttgtttccagaggacaagaatccctgaaatattctcaagaagagagaaagttatttgcctggaccgcagagcacagagttgatgatgagaagaactacggaagagatatcttgggctgtttgatacgagcagcgggtgattctaagagtcagtctgttactgactgacacaggcaggtctgagattactcacataacacttctcagggcagcaatccacagaagtccacattgctctcaggatctctgcctgaatcttcctaatacaaagtgaaaggtggcatctcatcaatgagcctgaacttaggcttgtttttcatgatgttggcctgtacctggcacaaccactggtaactcacacttggctgggccattccttaaaaataaagcaaagatctgcacaattctgtgagatgatacttaataggccactgtaacattttttaccatactgccttaaagtgtacctcgacagctttgctttatctctaaaaattctaaggggaatacataataaaagacctaaattaccccatttagataattcccaaaaagattgaacttatttgttttttctaattataacttttagaaacagcaaatatgtaccatccacgttaatgtcttcttaaaaagtcttaaaaatgcatgtaaagacttacgatcaaattgaatatatttttccacttttccaagaaatttttatttgctgtatgagatcagatcgctgattcaggtaacatgcgtgtgtgccgtttaaagtaatacacaacgtaacatgaaaagtaatgtttatgaatagtgggaagccgaagaagaagggattttgagtcatgggatgtgattactagctacgacatttggaaactttagtaagctctcccagccatttttctcatctatgaaagggcaatatgaagaccttcttacaacatgtttgaagcgtttcagttgtctgataactggtattacccagcagtactctgatgggtaaggttcacttgtcaagttcaggataatgttggagctgcctagaaagacttggtactaatacttttactttatgtacaaaatgacaatgctgtccttcttgatatatgcctatgtattcatatatattttgtctgtatatatgttcaatataaaagtcatttttcctcttgtaggaatttacagtatcaaagatgaggaaaatctatcagccagtgaatgaattcacatttttttacataaaacatagttattttctctctgctgtgcaaggtgtactttgcaaatctgaaaaaaaaaaaaagcttaggtttgttagattctagagtattaccttttatgatgatatcccacacctcatggtacagcttatatttctgcctaaaaccttgtcttcactctttacagtgagcacaaccttgttttttcattctcttatcggatacactttgtccattatgtcttttcagaattcatatcatgatttctaaggcattaaacattactatatatcatgttcgttaaaaacagattacatttttcacaggatatttctagaccatactataggtgactcaggtatacttgggattttgaattagtacaccaaattgatgtttcatggggttttttttttccctatgacaattgattttatttgaagcagcacacattgtaacttaatgcaatgctatggcattttgtggtcacaatcaagataatgaagcacttgtgattcacttacattaacccatatcacaaatgcaggtagtatgatgcttacctggtacactgtggggtggaaggaattcccacagcaactctgaggttagcatcatgggaaggaaagagagagcatgtctgtgagtctcttcacctcctctcgctatttagggttttgaaaagcggggaaaataaaaagaactccaggcctaacaaccatctggtaaaagaacaggtttgataaaatcaaaaggtatggttgaggggcaccaaaaacatggttataaattggcccattgcaaaggagcaaataaatagtaagagatcagaaaccttctgctaaattgggtccacagtccggaaggaactagaatgccaggcccagatgtttggactttgttaactacagtagagggtggtgaagaattctgagcaaggtttagggtgatgagcatccaattttaagacgagtctattatctgcgtggacttggatgtggataaggagatactgagtgtggttctcaaagagtggttcctggactggcagtatgagcattgcctgggacagtgctagaaatgtaaattttcagtcacactgaagtggaaactctgggtgtggggtccagccatctgtgtttgcacaagccctcccagtgagatgggaatgcatgctgaatgttgagaaacgctgggtagcaggtgcacagagatctttcacacgtaggaaagtcaccgtcattggacccgtgttggggggtcttacattgcacagtgacttgacgccacctgcctggttaattgtggccttaccagtatttacagttactaagaaaatctaaagaactttttttagatgatcaacttttatgttggatttaagatcaggtacctgtcactaaccttctttaagttattcagtgaatattttccctaactcttgtatgaaagaatataatctaaatattcctttgtttgaaaaattatattatgcagaaaaaatattatcttttatatgaacatattttttctatgtttgcctgttattaatcattctttaaatggaaggattctctctgaatttcttggaaaatattaaaattgcctcagtttccctacagacatttggatacacataggtcctatggagaaggaaccacagagaaaatcagtcaccagtacaagttctagctgaagagtattctatatttgtaacttggtacttcttcctctttgaccttaaatgtcagataaggaaaatacgtattttggggctgggtgcagtggctcacacctgtaatctcagccctttgggaggcggaagcaggtggatcacttgaggtcaagagtttgagaccagcctggtcaacatggtaaaaccccatctttactaaaaatacaaaaattacctgggcatggtgatgcacacctgtaatctcagctacttgggaggctgaggtatgagaatcacttgaacccgggaggccgaggttgctgtgagctgagatagcaccactgcagtccaaccggggtgacagagtaagacttcatctcaaaaaaaaaaaaaaagaaagaaaacgagaaagaaagaaagagaaaaaggaaataaaaaatatatttgagataatttaattcccaactctccaaagtgtgtttcacatacaacagctttggtatcacctgtcagtttcttagaaatgtggaataccaagccgcaccgtagaacaaccatggccaaatgtgcatttactgaaatctctgggacattcctagacacactcaagtttgagaagcactaacataggtccattgcaataaagaggtttccattgcaataaagagttagtgtgaatctgtcacatattttctatttgtaggactgggcttgatgatgttgggatgaaagaaaggggtgtcctccaggaagaacctatgatttgtttggtaagggaaggtgctattcgtctctaccctaactcagctcctgatatccataagttacttcagaatgagacacaggccggttctccagaaacatgtattgtagcaaagtgaaaataatatttatccaaatataattacaaggccgaattacttcattaggcataaacaaaataatgtacaatctttgactgaagatatcacacctgcaggaaatcagggctgcaggaagtgacattagacccacctagataggcagataggacggtaggacattaatcaagaaactacagaacaaggtattccaggtttaatccaaatgagaaacaaatagtgaaccaaagaggtacatggtagtgtgccacgtgtcctgtggaggtaaaaaaatatatatatatggcaatgactccctaacaaacaagaccactaaagagacctcagagctcgaagaaaacatgacccatggaacactgatccgagaggctcaaatgtggactcaattgggaggtggcaaagtccatcacctgaaagttgatgatgtcctgttggcttctttcaggatgctgtatctgatgtgtaatcacatcattagacagccagggtcaatttgtaaggaacaagaaccttattttctgacacattactcaaagttgccaaatagagtagtgaactaagtatgaagaaaaaggcaccgtaatattctacacattgaaattcagaaacaggacaaaatgccggcaattactgtatctgtatatgagaagcacacttctctgctgtcgataataccactttagactttcttgagagtaatattttacataatgtgtatgttaatatcacattaatattaatgctctggcattggaaagcttatgataatgacatagtgcaattgttttgttgaaccctgtaggttgagtacattttttttttttagctggacagattaattcatcctggatattctaaaaacacatgggtgggacagaggcaagaaaaccagttctgacccgacatggcagagacaaggagtaaattttagaggccactggtgcagagtcacactgaagggtaagaagaacacttaatactcaatcgctaaatggaatgcagagctcatacaggtttctccaaagtgccagtaagaaggtctccacctagctcagcagacaagcagcagcaatacagacagcaggcagttatccaatccaggtggtcagctacacgctactttaataacacagaaacgtgcattcatcgtaagactagaaagaataaaacaatgcatgttcaggaggtcagagtctactgagttcagggaggtagagctggaaactggagaaagagataagtggttaagatcaggatgatcaatggctgttagatggaaggaaagttggatgtagctactatttattcagtatccaagatgggccagtcagtgcattatgtaatttaattctcataaaatgttgcaaagtagacagctctactctatttgatacaaagaaatgtgtacctcagcaggggtctctaatcccggggccatggactggtaccagtccacagcctgttaagaaccaggatgcccagcaggagatgagtggcaatgagcaagaattacccctgagctctgcctcctctcagatcggcggcgacattagattttcataggatcgtgaaccctactgtgaactgagcatgcaatggatgtaggttgtgagctccttgtgagaatctaatggctgatgatctcaggtggaagtttcatcccaaactatcccctgccacttgagtccatggaaaaaaaaatgtctttcatgaaattggtccctggtagcaaaaaagatggggactgctgccttaggaagatccaacaatttgcctcagatcacatgtttttgtaaacagaaaagccaagatttgaaacaaaaaactccttactgggtaatagttggagtaacaggatttgacagtaatgggtgagggcatgacttaatcaatggaccctagaatgtgggttgggaggtggtcaatgggctgaaaatcatagaaaatgctgaagtatcagaagtgagattctccattttattagtagcaatgttgctacagtgcttgaagattgttgtgttacttctgtcatattaaggcttagcaatgtgttcaggctggttttcaagacaaataggaatctggcaacaatctgtacaaatcattgcaaaagaagaacaacgtataataaatggaatagagtaagaggaaaaggagggaaagaataagagaaacagccatttaaagccaatactaagcactgaaatacatgtctggtcctcttgttcatagtcacacatcatggcatgagatctaaaatgatctaatgggaaaagcactagagaagagtacagtataataaaaccatggtaatatcaggatgcaaacaaagaatacttgtgaacaccccaagagcttaataaaccacactttgacgccagaaattatgttggcttgtcacatcgaaaagcgttaagcctacataaagacagttgttccattctttgccatttcaaaatctaataaagttgttaaacagaagtacattctgtgaacataaattggaggagccagatactgttttacttcggtggttttcagagaaactatcaaaagatctgagccccaaggctctccgaatgaggactctactttatgagcaaacgtgatcggcaggttggtgtacatgttccaaagcgtggctcccttggttcagaactgacaatgcatgtgtgagatctatcaagtggaaaataatttgaagtcattagagtaagaccaaaaaatgcatcagcacggatttcagggaagatgaaggtttactgaaatatgcccatcttcacttccaatcaacacactttgaaaaaaattaaattggagattgggttgaagctagcaagagtgtcactgatgcagaaagaaaaagggaaaaagtggaaaaatcaaagaaacctcagtacaactggaaaagaacattactaagcatttgaaataaaaatactattggccaggaagaatgatcaataaattctctgcttttgcatgctgaggatatactatttctccacggttatcagtacattcatgaccctcccccaaaagtatacacacattaaccttggactccaggttataaattatttctttactacaaaatcgttattaaaagccatcttattaccaaagtaatgtcaataatgataacactatgacagctagcaataatgaaaaatcataaagtttcaggctctgttctgtcctttatagaccttcttgtatttaataatccatagtgtttggatgcacgaggactcagatcaagcaaacgcctgagcacggcatgcagctggctgaaaaagtaatgctcggaaatgagaagagcaagctctggaacagaaggctgcagtgtcaaccagctgctgtgtcacccagctacagtgtcacccagctgtactgtcacccagttgcggtggcagctagctatagtgtcacccagctacacagtcatccagcttcagggccaccaagctacactgtcacctagctacactgtcactcagctacagtgtcatctagctgcactgttacccaacttagtgtcacccagctacactgtcacccagctagagtgtcatccagctacagtatcacccatctgcactgtcacctagcttcactgtcacccagctgtagtgtcatccagctctactgtcacccagctacactgtcaaccaggtacagtgtcacccagctgcactgttatgcagctgtgctgtcacccagctacactgtcacccagctgccctgtcacccacctatactgtcacccagctgcactgtcacacagctgtgctgtcaaccagctacactgtcacccagctgtagtgtcatccagctgcactgtcacccagctacagtgtcacgcagctgcactgtcacgcagctgtgctgtcacccagctgccctgttacccagctccactgttaacactgtcacccagctccactgtcacccagctgcactgttacccagctacactgtcacccagctgtggtgtcatctagctgcactgtcacccagctgcagtgtcacccagctacagtgccaaccagctgcaccatcacacagctgcactgtcacccagctagtgttacccagctacagcatcggccagctgcagtgtcacctagctagtgtcacccagctgcattgtcaaccagctgtagctgcagctcaacaagcccagtggagagcaactacccttcccatgggaattaagttataaatattttacacattaaagacatgttttaagcaagttcttaagctcagggtttggagtaaaggaactgaagaaatggacattttcaggacacagtacctgtggtagggtcatactgaagggtgctatccactgtcaccttccagtcaggtcaaaactgtgccctgaaagctggtcatacagcccttccaactgctaacctcagccagcctaccaggacagttgctcagttatttgtcatatttagcccagattataacaaaagccaccttcttgtctagtttctcagcctccaaaaccttttcctctcactacatacttatgttggagctatattgatccttgagaaacagaaattttacaacaacaaccttctttttaatgtccttagatgtttttccacttccttatgacagcatccaaaatgagggtccttccaggtctagtttctacccacctctgcggttggatcaataccaccccatctccccacgtacaatccctgtggccaacatgttgaagtaatcagcatacccatatgggtcatgttcagtcactctttgtgccagggcggagaatctgtccagcaaactcacacctgctctgaagtagcacctcttttgcaaagcgtacttgaaagtgccatttcttagcagggcggggagctcctttcccttggctgcccacactggtgccaactttcctgtgctcttgtccgtcctgtgttcattgttgattggcctcctgtcctaggccgtaagcacctttgacagtactggcaatctttgtgtccttgttacctaacatggcgccagtcagtacttatgcattaaaactagagatgaacccttctctatttattcctcattttattgacctcaattgttttcttttcctggacgcgtacgacctttgtggcttctagcacatattttagcactgaaatatgtactgtatggtcccatttgttttttatttttcccataaaatttttgagggcagaggttcttgaatagagtcactacagtttaaaatgactgtaacccctaaggggaccaacagagtattggggctatcagctatgtcctgagaaatcaataaataattgatgatttattaattaaatttagggaagatgttaatgttttagagaaggtcttcctcaaatatatatacagtggttcaatagcagaaaagtaggattttctgctcaggaattcctacacctgtccattctgaactctgaatgagaaacaaaccaacaaataccaggtctgcatgtggattcaaaatgagtgataggtgcacctttgatttagtaaacattcagcccccaggcaaatcttttttctatcttcatattccattacaggatagatttatgtttattgtgacaacccaaagatatgacagactctcaggtattctctggaacagtaggttttgtacaattatgatgcgacatccataatattattcaacttacttgatgacatgtcacacaaactttaacactttataatggcacttgattagtaacttttctttctccccataacagatcatgccatataacagagagtttactacacacatagctcacataacatcagagtagttgtccttgaattgttcaaatgttgggttttttttggttgtattcatgcttcttgcagtagttttatctgagctatttttattttctcaatatgtaggggaattttccatactcataagcttgttgctggatggcttgcagggattgatggcttatagttgactccactttgactcagctggtagaaactctgctatatggtgagaaattgggtgtcagggcgattgtaatatatttccctccataccttgtttgtaagtacataatttaggtggtaagaatagcattgtcaaactggggatctgggcacctcctaggagctctccagttctccgtgactagattttgattttgtgtcttcatttggtgattatataactatatctaaacatacactgtatcatccacatggccaccttacttgttctgtggccaagattccataggctataagaagcagcactttaatatcctcaggctaatgagaaaaaagatggagatgaacttacgaagcaaatagcccatctgggccaaaggaaagcaaatgatatcacagaatgtttcatggaggaggcttttgcagtaactttaatagggcttcctcacgggattatgggcatgataaaggaagttgataataataattctattattaacgattatggtgataatttgtgttacagcagtccattttgagttgcagtttagggttacttaaaatgcatagcctttttttttttactgaggtagttttgtatgcatttatttatataacttatagtgtacacaggctttaagcattccaagtttatgcatgactttaagatcataaataaaaatttagtttatatatgcatgactttaagatcataaattgaattaaaagttaataacaggtctttgagaaacattttgttttataattggcccacacgtattcaaatgtaggaatcactgttagagcacactgcttataagagaaacctgacccaagtatttgactgctcctgcacacagctcttaagtgtagataattaaaattgctagtcacactatgaccgttgtctctgtagaaagggtaggctgtgtcatctcactcctttgttttgataacttcttgacaccattgtgctactaacccttgtctcgttgaaattcagactcctgttttaaaaacactgggtctctgtgatttcagtgctgtcatgaatacatccagtattgaaaggaacattcggaaacttccagtacaataatttcccttaataaaagacaaaaattagatccagggagcaagtaagttgctcaagagaaatggaaaactagaattgctatctaggatgtcatgttaagcagatttcattaggggtattgatgacatgatttgtgagatagaggttgttattggagaaccaaacatcaaatagaattaggtgatagacaagcgctttttaaaatttttttcctgacatttatttttggttcaaacttgatgtcacaatcagaccatcaattcagactctcagacaatatacttgctgtttacgtatatttcttaattaaaaaaaacatattcaggatcgagaccatcctggctaatgtggtgaaatcccgtctccaataaaaataagaaaaattagccagtgtggtggcgggcgcctgtagtcccagctactcgggaggctgaggcaggagaatggcgtgaacctgggaggcagagcttgcggtgagccgagatcacgccactgcactccagcctgggtgacagagcgagactctgtctcaaaataataataataataataatagtaataatattcaagaccttatttggtagccttttattgaatttactttctctcccaagtgttcaacgttttggagacattacatgtagcattttccatgtgaagattaatcactgttgttaacatctgtttggactattagtcttaatgttttgctaattcagcaaagtgagtatatggaaatctggaaatacatttatgcatttttcccaaggcgatgtcactcatagacagatacaagttctggaaggactgttttgagaaattttggtgacagcaaccaggctatagaattggaagatgtttgtcacagggctctagatcatgtttttgttgtgtcttaatcattacattgactgaatcaaattgggcttgttactcaagccccaagaatgggcccatcaggaagttaccatcagaggtgtaaatggaaatcagcagctacatgagtccagcgctccgcagtcatttcttcctttctttttctggaagaaaccacactgcactgaatgatttacagtaataggggaggttaacaggactatcttttacaagtgggacctaaagtgcctattggttggtgcctctcccacctgagtgtgcatacagagtttcaggggatgaggttaacctgactattcccatccgacttgtctggaagggaacaagccaggtcagagctgtggctcacactgcaggtacaactggagtgtgaagagttatgaccgtaggaaatatttcttaaatgactgaattaggaatgaataaataagtgaaagaacaagcaaataaattgacaagttaggaactaaatacaaatacttggattataaatatgtgtgtctcaaatatagtaattatttaggataggattcttccctttttgagactttactaaatggtacatatatgggcattagaaaggtaaatccatatatgcttatttcatgtgcttatatccttttaggatcatatttattccctaaggatagatacacttaaattgataataggcctaataatattgattttttcttttttgtctgctaagatttaaacattgtggattgacactgttgtgttaatagggccacagaaacccacaatcacacagtatttcatttaatatataaaatatttcccttgtgttataaattgtctcagttgtaactccaaacataaatctatgttaataaacatagataggtttactttacataatttaaatagaaagcagtagaccatctctttgttgttgtaagcacagtgatcattttaaacactaattattttaattaaatccattttcttagtaacaggaaactttgttggtgtctctgaattagtgatttggagataaagccaatgtctaggtgattcatgaatcacatttaatcaatatgttaagaagtccttgaatgtttaattataatgaccactggctgtactccacctataccattcaaataataaatacctcacaaatggcctccactaagctgctttcataccaaatgggagattcatgattgactcttctaattaccctattcatcatattggaaattgtcatctgtatggtacagtgttgaatactaggaacccactgtaattttataggatttataagacaggtgtgaaaataatgttcctttagaatagagccagagcaaacccttgtcagtgaatttgaattagagcacctaaatatttaacagccctatgcacttctaattgacatgtggaagcagagacacttccttagtaattctagttaatcaagaaactaattcatatagttggaggcaggaaaaaggatcaatgaacttttcaattagactctcttgttaggttaatagtgaagtcttgtttagccttagcactgagcatttattttctgtaaatagccccatacagacaacaaatcaataggatgtagaaatctattttaggtacacttttgaggaatctatcataggattatttttttttaatttggcaaatgttaaaactacttgtagttctatatttgaggtctcaagataattcaagattattttcttttacttgaaaaaacgtaaaattatgctggtctttggaaatgtctaagccatgaaggatgtgtctccccttgagttgcaacacccatttaatcctcgtgatagaaaaaatccagagcaaagctttcagtggtgaagatgagactggagcgagacaggtgcacaggaagtagattacagtgtggagatgggactgcagatgttgacagctgttgtgatacctgcgttcttgtcttctgggtttagaacaattcaaacaaaagacacacagcaaaagaagtgtagcatagagtagtttttgcaaaggaaaaagaatatttttaagtgaggtgcagaatagacggaacaccgtgaaagagacaattaacggcttgctgcttgtgaggatgtggcagcaatgaccagcactatggagactccctttatgggagttttacattattattcataaggagatgggaagaggtgttgccagtaagcaagttctgggtggtcctctgggtgcacacgtgcggtaactgtacatgcttgctcatgaattgcatgtctcattaacatcttaaatctccaaccaggggtgtgttttttactattttaatgaacaaagggtcagtctggcaacaggtaaaatcaaagtgtgcatgctctctataggggaaattccttactgaagatagctttcttgaatgagctcaattacaaagcgaatgttaatgcttattgtgatggctgtattgttaccacggttgctgcggttgttgtgttttgaggacatgcccatttccttgactacctctcctaactgagagcaagacaccatgcacagtaagtagattctaatggtggagatgggactggagctagacaggtgcagaggaagtagagcagtggcgtttgcctttggtttcataatatttataaatttaatttgtaaaacaaaaattgtaataaatgttctggttttgcttttgctttatcctttgcaaaagctatcatactgtcctcattggtttcaggagttgatccagattttgttaagcttcaaggtcatacaattttgatgaccctctaagaaaaaaaataatatatatatatatatatatataaaattgtgaatattattagtttgggacataaaatttttctttacaataagaaatcacaaattacttgttttataggctaaaatattacaaatataagaagaagaaaaaatgtgttttaagaggtttctagtcactttatttctgacgtgccctgggaacatgttttttcactgcagctttggctaaagactctttgattacctttttgtgtgaggatgattttgtcatgttttttgcagagataatagaaagctaattccagcatttctccagcatacttggtcaaacttgtttaatccatatcactattattgacaagttattttcagtgtgaaaactgaaccatgattgttatgtcatattttttttttatcactgtggtcagacttgagaaaacttccttcaagttaatttcacagagaggcctcttgctctgtccacatcaacgcttgccatcctctccactcacctgctctgtgtctggcccgtggaacacattctcagaacctgcacttgggcgtcatggctcacctgagttcacgtagaagactgtccaaattgtcctacgatggctagcaataacttcataatgcacagaagtggcaaaaaaaaaaaaaaaaaaaacctgcctaaatgtactcaaataagtgcctacttaattcaccttgaacccagtctccaaaaatcccacgacgtgccaagcaacagtactgacgtgcaccagagtgaaagtaggagtggggagagaacagatttaactggttttacttagagtaatcttattattattattattattattatttttgcaaaattcctctaacataggattggatgcacggtctcttagatcctcttgcagaacttagttggggcctgaatgaatgaggggctatgaagcctgtcacttcacaagctttggggaagttctccttgatgatctgtgtaggtaaaggataacacatagaaagcataatacgttccccacacgtcttcttgaagacataggctgaagacagtttcccttttcagcaattaagcgttgagtgatgtgtagttgttctttgtgctggattattgaatgttcaggtatctgagtaaatgcttgacctcagcactttaatttaaccttgtaaaatagggctacacattggaagcaggctaaatgcctcatatatttggggctgttacctttcactttactgatattatcttagagcttatgtatctgtcctgcctgaataggaaactttgaaaagcacacacacaatgaaccttacccaaatgtgactttccttaattttttttttttttgtttgcgactatcatgttggtgatagtatcgtgtgctaatattgaagtagccgatgctgtgcttttggacgctggaaaatgttcattttgctcttaagagtttggtgttctgataattttgtaaatcatgtggacataataaacgtgtcagtaactagcctttttttgggcaagctttaatggattaccattacagatgagagaattaggcttgtagaaataattgatgtgcctaaatcacatagtaatgacgttatgaagcagagattcagtctccagtcagtgttatactgcctgggagactagtgttaggagactgagttaatcctttttttttcgttttgagacaaggtcttgctttgtcacctaggctctagtgcagtggtgtgatcacagctcactgaagcctggacctcctgggctcaaacaatcctcgcatctcagcctcccaactagttgagactacaggtgtacacccccactattggcttttttttgtgtgtgtgtgattaggcatggggtcttgttatgttgtccagggtggtctcaaactcctgtatacaggaaattctgccaccttggcctcccaaagttctgggtttgtaggcgtgagccaccatacctggcctcggatggattttggaattgaattgacctaatttcaagaacctgctcaggataggcgcggtggctcacgcctgtaatcccagcactttgggaggttgaggcaggtagatcacttgagcaaggaatttttgagactagcctgggaaacatggcaaaaacccatctttacaaagaaaaatacaaatattagccaggcatgatggcacatgcctgtggtcccagcttcttgggaggctgagggaggatcacttaagcccaagaggtggaggttgtaatgagccaagatcacaacactacactccagcctggatgacagagtgagatcctgtctcaaaataataaaataaaacaaaaaaaaaacaaaaaagctgctcaattatttcacggccttcattttccttagctataaaatgtccataacatccatttcacaggttattgagagagtcgtatgagagtcgtatgagagagtagctagcacatagtcctatgagagagtagctagcacactcaagaaatcttgctctttcatcctctcattgtatatacttactgagtatgagcattttatttaaacagatattactatattttagtccctggaaatgtctgaggacaaaaatttgctcaaacattagcacagacaacagagccacatgctaacttgcatcatgctcccaatatcttcctttaaatgttttctggggcaggactcatttggagtaatcggttttattaaatttggggactagaaatatgctccatttctctgaaatcggaaaaatatgccacgtgctttatttcctgaaatcggcataaaaaccttatgtgttacctattattttgtcctttgagagatagagttattttgttccccaccgagtcctgcaagtgtgcctcaatgccttccttcattttcaaaacttccctcactcagctggaatcctcagtctcctccaagacactgcgagcttgttcaggtggcgtctgatgtcccctttgtctttgttttccacagtctattaaaatacctaccaagtagtaaaccctgcccagtgcctgttgaattcaagtgtgcaattctccattaatattaatatttttcaagtaaatcaaaacccagcaaaatatctgatgtttctttgcaagtttgaacaacaagaatatttcttatcttttattaaaagtaaaattgtattcttcttagggaatatgatactttagttatcaaaatgctacaaaagaagcactagtccatacacccaataataaactatcaaagttatattatcagattatctcatttgtcctaaaataaaaacacacaaatgcaatgataaattgggattcagaaacttttttaaaaaaatgtttatattttttgagaagggatctccctatattcccagggttgtctcgagctcctgggttcaagcaatcctcccacctcagccatccaaccgtctgagactacgggcatgtggcattatgcgcaactcagaaagtaattttgatatttcagtgcctttgacctttggtaatattttatttcatgaatacaaaatagtcaaaagagaaataaagaatttgcaacagaagagtatgggatacctatataattctctatgtctttcatatgcttaaggtgatactatacataataagtctgtttcacaaaatccatagctcaatttataggaagtccaggttgagtttcattttgcagatagacagtagataggaccaacttccagtatcttgatttcctcttcacactgtcagctgagtgaacttatgacctaatgagcatatatgtatacatacacatacacacacacagacacacatatacacatatgtgtgtatgtatatatatgtatatatcatgacctaatgagcatattttatatatatatatatatatatatatatatatatatatatatggaaagatcagaagcatatcaactaatgactacaatgtggaaggcattatttaatgttagtaaaaaatattaaaattttaaaaaatacaagcaaaatttgttttagtaccataagacatggcagattatcgtctcttcttcttttccttttaacctctgaaaaaaaaggcaatggctttctagaaaaacatttaagaaatctctctttaatttatcattattaaatttgattaattattattgctgctgctaagttagtcttgttcgaatcttgcatcgtcacacttcattttgttttctaaacactgatttttcatctgaatcattgggagtaaaacttctaacttgcagcaaccaatgaattggtcaccagcagaaaaaagatagttaacatattaagctccttttaagaattgtatgaaatggcaattatggtaattgaatgagtttgtaagtacttttggtcataaaggataaagtttctttaaatataatacaattaataaaatcttcacataaacctaaatggtataaagatatgcttttaattatatgacgaaaatcatcattgatattgaagtcacagaaatagaatacatttatagacagagggcatcattttctagaatagtacctttcttagctcattttagaagggctatttggaaggacccaaatggaaggaccatttggaaggtcggtttgttgtcccagagactgggactcaataaggtcttcagccagcagcaccatctctgtcccggcagcctctttctctctcagtgcacaatgagattaatctcaacatgatagagcacttgaccttgcttgtatgacaaagatcttgttagattatgcagctgggccattattagctcagctttctccagctggtacttgatacaagaggcatgacaaggtcagatgggggagccagcaaagcgctttgtgtttcatttgagctaatgataatcatctcctaaatggcgcttctttttaattatgcatttgcacatgaaccttgcattaaggtaaaaaaaggtttccgtatagaatgaaataggcttctctatgaagcttgtttagagctcatctgactgagtaatcaccatcctttgactttggatacaaatgcttgccttgaagatcaaagtgtcaagcttatgttaacaagggtttggcatttgggtgtatttagcagatcatcacattttgcttattcctctaactttatgtctaggttttgatttgaagtttttaggtcaggtatgttataatttttatgggatgacgaacattgcatacaaatgatgttagttatccatgttatcccacttaggcaaaggagcgttggtttttaattaatgatattgcagaaaagtgataactgtacagtattttccaatatcttttgtacgtttaattaatttctctgccagaagttggactcctttaataaccagataagaatcctgacaagcttgttttctctgttttcttaagtattgctattgaaagtattcttttcctgattgtaattgatgtcaactgagttttcattattttgttcactctacataaaagcatgaataagacttcgaatatttagtttcttccttgcacagatgaacaaacggaggcagacagaggcaaaatgccttttctgataccacacactcagttcatttagggagatattacagtaatctgagttttttctatccacagatcaaagctatttccttccaaacctgtgacctctgtgtaactcagatacataggtattgtctcttaactctaggtgtggaacagtgttctcaactctctatttatattagaattacctggggagctttaaaacataatttccttggccttgctctacaggaattctaatttaattggttgagattaaggtctggacattcatgtttacaaaaacaggcaactctaatgttcagccagaggtgagaactggacgcctagaacaaaattagccccactttcatggatagggtctataatttgtccatacatttcagacagagtagaaggtaacttgttcttggatacatctggaaagagctgttgatttatcttgcttttattgctatcctgaaaacgtctcagaaactatcacctggcgatggggggaggatgtaccgtgggcctcccaggtggttgtgtcaccactgctgtgcaagaacattgatgtccttctcatggctaagatgttccttgttgacgctgattgcctctgggcgcttgaacacttcagcagctggaataccctctacgcatgccatcatcctcacccacacaatagagttttggtagaagtcccaccctctacttttcagagctcagctagagtgggattgtgtcttgatgtgtaggtgggaaaatgtgtgaggcagagtttgaaaggtcactgaagtccatgtggtaccaggtgatcaatgcttctctaagtgttcataatgcatttatctgaagacatgcatttcactgaaaaatgacctgagtcccctgatgattggctgtgtttatgctcagtgaatcattaccatgcgagagccagtatagtgtagccattgagggcagaaagttttgaattagatctgtgttcaaatctctattctaccctccttccttctgtaatctttggcagtatatctgtccctaagtctgtgtcctgcagagaatagggctgatgacagccatcttagaggcactagattaagacttccataagtgtctaacatgtagtaggttttgaatcatcagtagctgttgttagaagatacatctcactactcagcaaactgcagcctatgggccaaatctgactccagggactttggaaaataaacttttcctgcaacacagccacgcttcgtcattaaagtgctgtccatggcctgctttcaaacttcagcagcactgctgggtagtgtgacagagaccgtatggctgacaaaaccaaaatatttattatctggccttgtaaagaatatgttaaatcgattacattctaaatcactgctaccacaactagcacacaaccaatttgccaccacagtttgtttaaaaaatatataatgggcctggcacagtggcccacgcctgtaatcccagcactttgagaggctgaggcagtcggattacttgaggtcaggagtttgagaccagccaggccaacatggtgaaaccccatctctactaaaatacagaaattagctgggcatggtggtggacacctgtaatcccacctactcaagaggctgaggtaggagattgcttgaaacagagagacagaggttgcagtgagctgagatcgcagcactgtgctccagcataggcgacagagcaagagtctgtctcaaaaaaataataataaatgtgtctgtatatatatatatgtatgtatatatatgtacacatatatatgtacacatatatatataatttgaatcaatattgctttgttgtgatttatgcccataacttatcaacttttaacaatttatatttattcacagattaacaacaaactttactcctatttagaaaaatttagcaaaagagcaaattgttttgttcacagagacgtttgccaggtcagacacatttttattctagaactgattgtttaagaaagtcagctttctgtcataaataaacttgactccagtttgtttgtgagatggagaaggggctgatattcctgagtgcctgaaatttcatgagctcacacgtgcatttctgtgagcttgagaaagatggagagaataatgagggggaatagagaacagaaagcaagaaatgaaaggagcagacgctcatcatagccgattctgatgttggatgatgactgcctaatttcattactaggtggagcaacagttcttttttccctagtattctgagacaacagaccatctagagacatttttcgagagtttattttcatctctgagaaaagcagaaatttgtacttcagcttttttcaaataattgatagcatcctgtgatgggatattgtcctcataactactccattggcagcttcaagcttttatattttcgtttaaccgtttaacaatataaatgtcactaagtgtgccaataaatactgacaaacccctgaaaaggtcagattgattctataactcacacctgtctgatgctagaggcttttcaggattttctgtgaacactaataaatagtctcccataagggatcttccacttttctgatctgtgaatgtctcttaataaactcaacgctgatacagtcacgagatgggatcttgttaatgaggtacacagtttcgacaaatgtatctgataagcatgtatatgagaagctacttgctttataagcatggtagaatcatagacactaggtccattagaaactaggtacatttatttcagagcttactcatttgataggtgcatatatatatatatgaatgatgccttctgaatgtgtgtgtgtgtgtatatatatatatgaatatatatatatatatatttagaaggcctttaatataaaagttataatttttatggtagcaaaattctcagccttggcattttcatacacagactgacgacgaagtagagattctccttgcgtagcgtaccaaaaggtacacaatagaggtgaatactattgggattagaatcattatttactcacaggttttatacaagttaaggccaatcatggacattttctcagttgagttagtactaaaattataatttaaaagagaagaatatccagaatttattggtcaacattaagtaacgtctttttgtttaaccaaatcagaacaaatgacttctcaccgatgtttccatgtgtatgtgtgcaattccacacccaggtatatcagagtcctgagtgactgcagtgttgggaccccgaaggaggagaatccaggtgtgaagttatgctactgcggggccctgctcaggctggcagttgagatttttgttctctggtgtctttctgtgtcccttgtaacaagatttgtgctagaagatgccacttttggcaagcaccatgtcactaacagttctctagggaatcagttgattactttatgcaagtttgtatattgcacatataatgttttatataacaaacacaagtggccattgtatgttaagttgaagacaggttagacttgccattagaggcgtatcaaaggataatggaaggcttattaaacaaacttacctatttaaaaagtgaatttaaagccacctgagttcatttttccctaaatattttcttaggaataaaaattcgaaactgacattgttaattacttttcaattcgctgtttacctttattggaaaataatgattttgaaacactgatagagaagttaatgttatcttttgcatgaaaactaaaatatttagcaaattctgaccttcaaatgtgtctgtttatcttagtatgtgcacactctatatctatgtatgtttaaaagcgtatgcctatattcatatattttaacatatatttaatttatatttaaatacacatatgaaaaaccgtattgttttcctcttttctgtcaaaattgttaaatgcattcattcctctgatcagtagttgttaatgggattgtttaagtagatttaaaagctgctttttccctgtggatttaagatgactggtttcagttgtttcaatgaatcactttcaagccataaatcataaccatgccataatacatggtacatgattgatagaagttagtgtaaattaataatatcagtaattgatatcaattttaataattgatattaattgatatcaaataaataataacactaatttttgcaaactattccttgaaggcatcagttcactgctttagttattaaatagtacataaagccgcatgattcatttaaaggagcagtgaaaaggtatatttgtgtgcatatacatatatacacacttatacacgagcatacatatatacacaaacatacacacacatacatatatacacacacatacacccagtttaaaactatgagaaatcgatagctggaaaacttcatgttaattgacttttttagtgtccaggacattgtgtgtattatattatgtcgttcagttctcacagtaaacatgtgagctggaaatactttatctcaatatttaatatgaggaaaattacaggtcaaatgaatcattcaaggacacgtatctagtaaattgcatttcttgcatttgcacccagccatttaattccaaggcctgagcttgcaagtatgatgtggttatttttattttgttatttacactaaggattcttagggaattcttagagtaaatagtcaagacacatttatgtcagtggctcttagatatgttcaggcgttttattggttcaggataaaatatgcatgcagaagtgtgcacatatcagctattgagagtcaacaaactttcgcagagagtttgtgaaacttcagtacaaggccaagatgcagaacattactcccacaagatgctagcatgctcttgaaatcgtcagtcccaactcaggggtagccattctcttggcttctgacagcattgactaatttgcctattttgacacattctgtaaatgacactgtagattttgcattgttttgcttttggattctttcacacaaagttatgtttgtgacattcacctacattgttgtgcacatttgtaatgtgttccttttcattgctgtgtagtattttgttttgtgaacataccacaacttatttatatccctgagggcaattacataattttcagtttgcaaaggttacaaatagtgctactatgaacattctagccttgggtgaatattgggtatatgcctaaggatgcgatcgtccactcacagtgtatgcatgtgctcaaccgaggcagagagagtctaatagttttgcaaaataattctactgatttgtaataccaccgtagtgtaggaaatttccagttgctccacataaccaacatttggcaggtttcctgtttttaaaattgtattttaaccattctagtggggatgcagtattctgtcatcgtcgagattttatttgaatttatctgactgctaatgaagttgaatgactttgtgtgtttattggattgatgatttggtgtctttttctaataagtgtcagttcaaatcaattacttttttttccactttatgggttgtctctctctttcttgttgatttgtaagatgtctgtatattctgtacacaaatcttggtggaggagccaattgtgatgattttttctcactttctggctaatggtttgaccagaatttcttaaatttaatatgtttagactattgatatgttttttcttttattgttaataccttttaaaaatagttgcatcatcagacatcgtagaatattctctcgtgattggttattggaaatttgtttcatctttcaagttcagatctgtaatctctgtggaattataaagaatccaggtaactttttctgtatgaacatgcaactgacccagccccatttatggagaagtcaatccttttccccttgccctgagcagtgtggatttgcttctcacttctgttcttccctttgcttagctgtctttccttgcatcgaccattcagagtcttaagtaattaatttctggagtaaattttgataactggtagtgtaaggccccaagctctgcttttctctttttttccaaattgtttttttttgttttcttttgttgttgttggtttttgtttgtttgtttgtttttgtttttgttttttttttttttgagatggagtcttgctctgtcacccaggcaggctggactgcaatggctccatcttggctcaatgcaacctcagcctcctgagtagctgagattacaggcacccaccactacgcccagctaatttttttgtatttttagtagagacagggtttcaccatcttgaccaggctggtctttgaactcctaaccttgtgatctgcctgcctcggcctcccaaagtgctgggattataggcataagccaccgcacccggccccaacttgctttttatatatctatatattcagtcttctttgcttcaatggaaatattagaattggcttatgaattagtgaaaaaaaaaagcaaaaaacaaagaaacaaaactctgttgaggtttgggttgagagtgacttgaatctatataatacatttgtagagaattgccatctttaaaatattgtgtcttctaatgtacaaacatggcacatatctgcattttttagatcttcttaatttcagtcaataatatttcagatttcgtgcattcagttttttatataattttttgaattcactcatagatagttgaggctttattgatattgtaaatgatttctttttaaaattttgatcttcatttgcctttgctagtacttaaaaatgcagttgtcttttctatactaattttgcatccaatgtaatacttggtaaataacattgtgtttactttcaatggtacacgaaggaggactagaaaaatttgtattagaaaaaatataaatgcgcaggtcattacgttatttttaggaattatctttataaccaaccatctaaaagaaaatacattgtttttcgtgagacaaattttggataatagctgtataatataattttaatatattttgcttatttaaggattggagctgaggatttgggaaacgtgtgcaaagctttcttcctttttagactttacaggaaaggttaagaaacatgtatgtcctagatttaaaatggagaatccaaaaatatagtactatttgtgtagtggaagataactggctattcacaatgctactgagaagcacttagtaaaataaactacgtggctttagaaaatcaaattttatttataactctaaggaaataaagtgaagcagcgagatatctcaagaattaaaatttacataaatatcactcaaatcctggaaactgaagctaatttggtcatgaggcagttcatttatatggcaatttggcatattgtttactgtcaattaacaataaagaacaacgatgcagtaataatgggatagtttttgaaaaatgtaatctaatatcagcatgtagagcaagagaatttgagttctcatgaatgttaagagaaggtgattcatatagaattgcacctgaaattgcattattttccctaactgctcctcttggctattcttgaatccaatttcctctgtaccatggtcgaaggtactagcagtcacagtagaaacttgtgacagtaaatgaatttagtaatacgtttgttaggttaggagttctcagtcaaaaaaaaaagaaaatcttttataatcttcgaggattttatacttacattagtcagtaacttcggtacagaatcaaaattaccagtccatcttaatacaattctaacccatcaaataaatatgtagtaagtcgtatcacataccaagcactatttcgttataggggataaaaacgtgaatacaacatccacaccagaagaagactaaaacgcaacacacacacacacacacgcacacgcacaccggtacacactctatacacgaaataaatgacaaatatctgaagctgaaagcaatgttagttcatagaaaaacgtgctagtccacatgcaacactttttctatgtaggttaggagttagcctttcatttttttctgagaactatgtgacgtcaagaaatattggtgtctacacagaaaaagatgtttgtgctttttcatttctgaaaccagttaataaaagcaaatctcattctgatagctatgtgattgttaaggtaatatcaatagagaatgacaaagtagactgtagcgggggaggagctacatcttccttgctctcacggtaacttggtctctgtcccatttctaagcaaaacgagaagcaaaaacctgggacattgttctcaatgaccggactgattcatttcctccagattaattggcttgtgctacagtgtatgaatactttatgtctatagagattccttagatgattctaatgaataataatcttgtaatgatttagatttggctgcaggacatttttgacatacatttgatattgatacatattgatgaacagtatgtaatatacaatcctatatacacaggtatagtgtataaatacatacctgtatatttctaggcaaagagaagtgtgctgtaataaaccaccacctgctccaggctttgatagtactaataaaacaaaatgattgtttgaacacctaagattcaagaagatgactacatgcttgggtaccccagaataactcagatgctatccctgttcttagagaactatccaaacttcagaggtaaaatatactaaattattagtactaatatattattttttgcttgaagtgcttgcatcatgattttaaaaacttagtcatatattaaagttattttctgtcatgtacattctctgagacttcatataacttgtgatattggtgaataattaagctcagtcagtttattatggtttgtgtccaggacacacttgataagatatggaaagctggatttgtggtcgtcgttatagttactcaaagtttgcacaaactcaggaagcataactgtccaacataaagtacaagggtctaatatttcccatgacacagtgtctcactgaagcatcagacatactagcaactcagactagttgaatatgaaactacttatttgggtcttttggagatttttctgtcaataaacagagatagatcttacagatttatcggtaaaaatgtttgaaataatgcacgcaattttttctatacttcctatctatataatttcctttttcattttttaaataaataaaaatattaaaaagctagcttgtgttctacttagttaatatttaagagtctgttcatgtttacactggaaaggcaagactggtatcattgttgatattattgttataatgtgggagactcttagaggcaaatccaggattttcttcgtgtatcaaataaagaagatacacgtgtaagaatattttaaagaatagtgtagagaatattatacactgggagaagagattgatttattttagtcccattcctggaaattgtatataatctaagaaattatcatctcgacttctcactacttgatattagttttatccctgaactacaaaatttggaattctccatttgaatctctcgtgcaaaaaatgtacaaagacaaaaggaaaggaatgtgggcagggaaggaggaaggaagacaggcagaagctgatagcaaatgttcaatgcatgaccacccagcatgaatatgtaattagatggaggtactaataaatcattttatctttggaaagttttatcatttacattcagtttaagtttaaaaaaaaaaaaactttgcatgaccttgatgtagacaaagctttaggtcatggccacgacctataaaatgatttacttgaagatacaattttccttctgaatggtttagtaatgtttgtttgtcattattagacaaaatttaagtcagttctataaatatacaatctccatgataatgttccatttaacttaacatgccatgctaacgctagatttacatatcaaagtgaattattaacggtcaaacttgctattttattgtgactgcatatgaaaatatataaaatgtacaagccatgtgctcagacccttattcaggggaaaatagacattctactgtaaggagtagatgaactgggcagaaattgtggattctggttgttagatctaacagtgtaaccctgaagagctcatttttttctctggcctttacctgaatatggggaacatcgaagcttgagggtatccataagtaaatttcctccctcgtcttagaagcaaattgagagagctgtagggcctgctagattaagagaattcatctggaacgctagactccgcttctgagcctgtatggaacgtgggttcggtctgcagccatgtctggcaggtagccatggaagagcacatgcctcccccatcatggacacagctggacacctggagggctcccagcatgcagaagtttcctttcaccacgcatcaagggccacaccaggacatctgctcactgtaggcaggtctcaaagcaagcagtgtggggtgctgagcccagtgtccacttccttcttccaaaagtcacttctcctgtaggaaaggtagaggaagggatggggaaagtgcaaaattcgcctgcttcaccgaggagttgcactacttcaggctgaatctcccttgtaagaaccttaagacattgtggttacgacaggcaaaaaaacactatacgaaatgaaaatgctcacatttcatatgaaagtatgttattgcttgagatctgtgttatgacttatgaattatttcttgtgcttctaaataaatcatgataaaaagccaagcatgagaggctggacagagtggatcatgcctgtaatcccacgcatgattttgggaggccaaggcgggcgaatcacttgaggtcagaagttcaagaccaccttgggcaacatggtgaaacctcgtttctacaaaaaatttttaaaaacttgctgtgcctggtggcctatgcctgtgcttccaggtactcaggaggccaaggctggaggattgcttgagcctgggaagtcaaggctacagtgcgcactgatagcaccactgcacttcaccccaggcaacagagcaagactctgtctcaaaaacaaagaaacaaacaaaaacaataccatgaagcatgataaaaagccagtacctcattttagaattaataattttttaggaataaatatgaataaatttctcctaataaattacatccacacttacacacttacatattttatcaattctgttaggactctccaacaagagacaggaataaaaggagaatggtgtctccaggcttctaagtgcagaattctttagaaatacaggaaagtttattgagtactctaggacaacactatacatgaaaactaacacaacagtcatcctgggctttgaaatgtgcatcaccttttcccatactaattctaaaaacttctaaggtaaataaaacaacacgtgaatgcatttgattttaaacgtctggcttagcgatatcaggggtgagaggagttttcccctcccctcctttcaaacatgagtttccttcacaaaacatgactgtcactggtttccagaggttaatttcttgcttttttaacttattttttaaaaggaagaaaacaaatatatagaaaagacaacaagtatatttcaaaataggtaattaaaatgcagtattaagatcaaagggtataaaaactggaaatagaactgtaggaagaaatgtaagacatgtggcccttcgcaattttacagttactccataaatttgcctccgagcttcccattgatctcctcataaagagaaacatggaaatttgcttgtgatttcctaccaagtttggaacacactctagtgtttccaaaaggcaatccttgattgatctgcaaattccctcaagctctcagctgtttttgtaccttccctttaccacaaagctttgaggaggtcttcactggctgtctccatttctttgactgcctttctttcctcaatccactcgagaagattctgccccctccctagacctcagccagagctgctctcctggaattcaccacccacttccatgctccggaggctgtgaggaaactctggtcctcctcctcttcctcctctcacaatgggactcctctccaataaaacattcctcctgaaggagcctctcctgctttccttcttccatgccggctgcttcctccccttttctccacctctccatgccagtgaccctcggaacccagttcgggcttttccacccattcacctacatcatctcactccctcctgcaggaactcctccaatccataacttcatagaccatgtctacgcagaagtcgccaaaacgtcactcactgtccttcttagtatctaattctccttcacctaatagaacagcaaattctttgagtttaggatccttaatgcagtgtaaatattgccttttatccttcttctcagctatggtctcaattcaaatcatgaggaccattgtggtggctcccgaatggcctcactgttccactccttccccactgcgctacagtccattccccagtgtcgcattttacatcgagtaatttccaaaccccacaatgtgttcctgaagcccctctaggatctggtccccaggcacctttctgtgtccgctcttctgctctttcagccgccccagctcatgccagcctttgtgcttgcatccattcttcttgagatgatgcagccagacgtccatcctgcttggctccttcatggtagaagctctcagattaaatgtcaggccccaaggtcttccccaagtcttattcaaatcactggtgcgcagcatcgcagtggatctcaccaccctttgccgttttcttaatgggtttattcatcctccgaaattgaccccgtctttggtgtgtgtcctatttaatgtctgcatctccttccaaaccctgtccttccccgtcacagacatggtatgttctcacctccattgccaagagcagtgggcgccagtcgcatttgttgtaggagggacttgcagagttttcatcatccacagagaaaaacatggcagcttcttttggaaaccaaaaaacatattccacatgtgagacttaatctactgaatgatgcttttaagaagatctccatcacagaggcagcaacatctccctaagatgctgcttgtatgtcttcaatgaacgccgacagcatgtgtttcaatgcaacgtcataaaagaagtctgtaaaagttcaagcactgaagtctgagctttctggtttctgattacttagtttgatccagggataaaacctataatgactgtaggagtcactgaaaagtacgtctttaaagagttctaaatacagacaatttttcaaaacctcactttagataagagttacgcagcctgtatttccaaagtacaggtggtccagggacacagggaccttgagcattctaacagtaaaataaacatgctcttcatcctttagaaaattgcaggaaggttaggaaggtcttctccatggctgtggaacactagataattacactttatagcacatagcagattgcatccccaggggaaggggtaggcctcctggagagagggcagtgaaagaacccagcctgaggatagcacagagaacttcctaaatttgaggggagggaagtggaaagctttacagatgctaatttgacagagaagttctacagccgcacagtgtgtataaacagacctatgtcaccaacacagccctcaagactgcactgttctcttttcagaatccaaagtcagatctagttgtctccaagatcagtgacctcccccagttcagccagtctggcttaaatgaatatctcctctgtgttcctaacatccagaaactacaaacaccgtgaccatgtgtgcttttctttctcccagtctaatcaagggctacgttggttcaggccatctgatttttctctgtatccttaatactgagaaaaaggctttttatttatttatttatttttaacttttattttaagttcagggatacatgtcatatagataaactagtgtcatgggggtttgatatgcaaattatttcaccactcaggtattatgccgagtacccattagttatttttgctgatgctctccctcctcccaccgtccaccctgcagtaggtctcagtgtctgtttttccctttatgtgtccctgtgttcttattattcaccttccacttagaaggtagaacgtgtggtatttggttttctgttgctgtgttagtttgctaaagataatggcctccagttccatccatgtgcctgccaaggacatgatctcatttttttttatgtcttgatagtattatatggtatatacatatcacattttctttatccattctacagctgatgggcatttaggttgattccatgtctttgctattgtgaatagagctgcagtgaacatacacctgcatgtgtctttatgatagaatgattgctgttcctttggctacatagccagtaaagggattgctggcttgaatggtagttctgtttttaggtctttgaggaatcatcatactagtttcctcaatagttgaactaatttacactcccaccaagagtgtatacatgttccattttatctgcaaccttgccagcatctgttgttgtttgattttttaataacaacaattctgagtagtgtgagatggtatctcactgtggttttgatttgcgtttctctaatgatcagtgatgttgagctttttttcatatgattgttggccacatgtatgtcttattttcagaagtgtctgttcatgttgtttgtccactttttaatgcagctgttttcttttttctttcttttttttttttggagctgtcttattgtaaatttgtttaagttgcttacaaatgctggatattagatctttgtcggatgggtagtttgcaaaaaatttctccggttttgaaggttatctgttcactctgttaatagtgagaacaaggccttctaagtagcacgaggctcttcatgaatgaagggctcaggaaataaactcattaataaattaagagaaaatgaatggattgtggaaactgacatgaaatgaatgcctttttactgaactctatcaagcaattctgaaacagacaacctcagttcttgagatcagcctttcagtgacctggcagaacattacctagttcaggcaccagggagcacattttacctgccttgtcccacagctttttcatttgcacagtgggcttcggataatgcgttttaactggacacttcaggaaggtagtaatgaacagttgagagtcactgaagcagggacatcttgccaacacagcacctggcactttgccgggggaaagctgggagaactgagaatgagccagatggcacttacagggtgaccccaaacctgacacgttcagttcacagaagaacccttttccctaaaaacaacaacaacgacaacaaccagaatgaagtatacgatctcacatttccattaaacactgtaatttaactgaggatccaaacacgggttaaaacaacatgaaatgagaaaaagaacaaataagaatggaaagaaatttgagaaaaccaaaagggaattggcctttcagcaggttgtatcctaaaagagcaatataatgtatccaaaataatgtgttaaccactatactcactgcacaccattgcataggaaatagtgcaggtttgtagctcacaaatagaaaatggcaaaacttaggctgtgtttttcagaagattagggctacgttaattcattttatctttatttcaaaatcaacacctgttattttctttcagaagggagttcttggctcacaagctaattgtgtaatagccttcacaagcttcacacttcattcacatcaacaactcttacatttaatctttatgtcatccaccattttacccacattctcaaatgttagaagggtggatttcaaaagcaattttttgagacacatttacctgggtgaaaatgattgacctctgtatgaaaagattaaaggttgagactaatggtaaagtgagaaaaaatatatcctgtataatctgaatttgaagactaatattcctaatatataaaaattatgaatcaataataataacctaatagactaagaaaaattaaaatcaagcattattcattatggagatacaaatgtttattaagtctatgaaaataaattcaacctcactagtaatttagaataatgcaagttgaaattaaatgatgcatgttaaaggaaaataatgcaagttgaagaaaccaatgcaagtttttttaatccattattttagtaagagacataatagttgtcaatatcaactatgatgttgtgattttccaacactactagtaggagtataaatcagtgcagctttttattgaagagtaatttggcattattaagtgctaaaatatgtattctctaattttaatatagttccttggtacacattgtagaaaaatatttgcacatttgcattagaaggcaaataaaagtatgatgagtgaggtattacttgttttaaaaaattgaaaatattctagatgtctattaataggacaattgttaaataaggcttaacatacgtaagtcatggaataatacacaaagatggagatttatatgtattgaatttttttaaaaaaattataacacattgaatgagaaaaaattaacttatatttaagaatataaaacaaaaatttacatttatgaatacataaaaagctatgtacatgcaataaaagaagaaaagctagcaaacggaacattaaactcaggcatctaaggaacctaagacagaatggtgttaatgttggagatgcttctttctctcctgtgtatgttttacaataagaatgcaattcctgagtagctctaattaatatacatttatttatggttaaaaatggccataggacattaacagaggagaatatataaatgaatataaatcagataatacttaacatccctctaatattcaggtaaataaaagcaaaaataagtagatcccatttcacctgtaagattcataaacatattggaagagtttggggaaagagatcctctgttacaaatagttggagagaaatggctggacatttctggagggtaatttgaccatagctctcaaacggtaaatttttcttagacattaatccctcaatttcaactctaataatttctttgagagaaatacccaccaacatgtaaagatatatgcatataaatgtttcatggagtgctatgtgcatagctgggggaaaaaagaggtatccataaggcactggtctttttacatatgtgctacaaatcatcatagtaaaaataaaaataaaatctgaggatatataatgtggaaatattggtatgtaacacgtttacacagttgaataatcttaatttcagtgtactattaattttgctagaaagagaaatatggttgacattttcttcttgactttctggaagaacctctttaaccaagattcaaattgtaaaataatgtgtaatctctgtttttattctacctgtttatagagtgcatgttattagtagataacttaataatcattatacccagagggtatgcttacagttaagcaatgaagagacgcctactttttgtttaatgtatttctttacacttttcctctagttatgtattattattgtaattttaaaatatatagatgacatatagctagctcactctcttttgcttaaggaaagggctagtttttcctttaagcccttcaagcactactgatacaaaattagatcagtaaggataattcataaaagcatggaatgtgattattaagtggcagttgatacggaaatctggcaagctcccatcttgccttccctgacatcaaacccctggccccgtgttgcctgctagtgcttctgctggggtgggtcctgccaggatgagcttccccacatgctcctggctgcgcgcacctgtgcacctttcctcctgtggcaactagaaaggcagaactttccccaggttagctcagcggtgagaaagtgcatgttttctctcactatttatatctgatagataggtttatatctacctgtgaaccaagtcaggcactctcaggaagaaatgataaaatattgttaagcatatcaaacgcattcagcctcactagccatttaggggaatgcaagttaaaactaaggtgagacacgctttatgaaggcaggacaggattggagaaaaggagtaaacaaaataagtcaatttcatagacctatcagtctctatgtattatataattttattatacaggatatagtatagccacaggtgatacatgccatggagagaaatgaagcagagaaggagaatgtggtgtgtcacaatttgagaaagagacccttgagtgaaggcatgcagtgctaggcagagcatcagagaaacaccgaggtggagggcctagtgcagaagcctcagggtgcagcacatctgtgtatttcagggcacggtgtggagacaggtggagctggagctcttggcttgtgaacaaggagagtgacactagacaccaggtccctaaggtcatgtcagcgtggcagccacgaagggaccctgagggcactgtaaatatgcttgcagctgttacttcgagagagctggaaagccatcggcatcatctgagcagaagagttatgtgacttaggttgtaatggagtctctttggctctggggtgttagccagggaggatgttggaaagatggaagcaagcacaccaattagaagacgatggtaacagtccagcctgagaaaatggtggcttggatgagcacattggccatgaaacacgactgatcagattctacttatattttgaaggtatagcgaacagaaattgctgatgtgttggatgtgggttgagagagcagagggtcaggagtgcccccaaggcttttaggaaggataacgctgcattcatgagatggaaagattgcagaggtatgagtttgaggagaaatattaggaacttgtttatatgcatgtgaggttcgggtcctattgcgtgagctgagtgggctgctggaccctcaaatccacatttcagaacagggttcaggctgcaggtacgcatttgggaattggtggtgttggtaagtgttctttgtgtctgttgaatgagagagccccttccttttggctgatgcaggtggcatgggatcggcttacagctgccccccagctgcccttgtgtggaccatctgcacagcagggacctgtggcctgcagatggcactactggagactttagggagaaaggaaggcaaaaaataaatgtctccgggtgaaaatgaaatctctcctgcaagcagggcgactgaaaaggcacacttcagagcaatggtcataaagttaaatggagatgcccccccatcctcgttctgggttttttctacaggcgcagtacatccaactgcaccaggtgttggttcagcagagtggagtggaattagggctgtgatttctgccaagcagaaagtgctaggataatttaaatactgtgcatgcaaggaattaagcatcatgagagatatggcaatgggtgatagggacagatcagggtgcagggccaaatcaggattggagaaggaaggatgaggtgtgtgacctgagaatcttgggtctcccacagtgacataaacaccagagaagacatacaaagattggctgtaagggtgtccaggcaggaggcggaggtgacacagagtcttgggaacggttcaggaagatctggccagtggtccatgcttcttcaatcctggaaatggaggcctagaattgagggaaggtcagttggaatgtgagtcatactccacatatacaggaagctgcctggccctgggaggagggttcctgtgccagtgtttgcataagcagctattattattaacaactgcatgagttaagtgtagtacatggttctaggtttctgtgaagattaaccaagatactatacatagatatagatatataaatatatagatatatgtatagattaaaatttttgtttaggtttcagatatccacacagttcattagaggattagacgtctctcactagccttctgttgtctgggacacattaaaacatatctgttttattctgacaccctcttcagcaggtcagatatattttgtttagttatttaaaccatagccaggaagactcaagggcaaatactcctgagtaagtatccttaaaagaaaagaatggaaatttggggtattataaagttcaatagaagagacatccagtctgtcctcctaggctaccctactgtttgtggtaatcattagactggtcatggttttccttatattcaagatatgtaatggtatggtcttgcttcttacactagctagctagttactaatttattcatgcattaattcactcttttgtctatatatacaattgacaagaccaaagaccagtgaactattctgcctttttccaccactcagtggaaaaacagtatagtagaaaaaaaatcaatcaatcaaaatggttacaatatttttaaaaaactggttggaaaagtaaaaactaaatagcaattctacaagtgcattaatttaatgcacagaattaaaaatattggctgactcaccacttttatggtataagcaaaatggtttttcatgaaaatggtggtacttacaaatccatacatgcatatgtccagtggcagtatgaaaacatcaccatgtcttgcaggaggatttgcagcagaactggagtcctagtaacatggtaaatttagttgattaataccgatttgaagtccttcatattaaggatttgtgagccgttattgaaggaaagagtcctcactttgcatatgtttgtaccatcaggagaatccctgtggctttgtagtggccaaggactaccttatggaatagctttgagaacagctgtatctatagaaatcttataagcttattatttcctgaatcacattccaaatagtgactttgggtttgagggatggaaagaagagactataaggtgttttcagtggctagtgtcatcaccagaactaaaaaggtcatttaaagaccaaaacgtacacattagatcatgatgctttaccacgtcaggcacccaacaggaaatgtgtaaaatattaatatcacaagcacacactatttaaacatatcaggtaatcaaattggaaacgcttccatttactaaaccatatgagctaagcaatggtaaatgaaatacatgaatgttctgtattccagtaaaaggacagaaatgccaatccccagggttcagccagccttttacagcagcttccttttaagaagtatttatttaaaaatgttgtttataggtaattacaaatggtattcaaaatctgtggcaacaaaactagaattaggaataatgctttactcatttaggcttagatgtgtatgtagttgtgaattaaaaccttaatgttatatcttcagagtattcataaacacttacatatggaataatgtaatccttatttggaagaaagctcatgaatagaatttttaaagacattttacttgttctttttaagtgttactgtgttttctggtggcgatttatctcactaacatgactacagatgatggtgaaattcctttcacttttcattattttaattacattcccagacacgagggaaacatgaggagttaattaatgtggttttgacaattacttgtaaatattgctatttataattctagtatactataacacgtgtttccagctcaaatggagcaatgtgagaagggtatttacagtataccaaaaaaagaggcacttattttagagaaatatgacggaaacctagcaaatagcattactccattagcatgtaagctgtgaatggagattttgttgttgtatttactgctccgttggaacctagaacagtgcctggtacttaacaggactgatggaatttcatcgatgatgtgaataaatacatgaaggaataacacattggcgctttgctgatgagaggcacctgaattctcctgcggcttcccactgtacgtgcctgcttggtccctcattgcctccacccccaactctttcccccactattgtcacccttttctgatttcccagagcacctcccatctctgaagagcacctgtgactctgcctctgagccctcacagtctcgcttgcaggcagagctgtgcaaggagcccagggactgagggaatgtgttcagttgcaaacccagtttcataccagcaagagcatttcagagtttacagattaaaaattgagtgcgtatgtcacattgaagtaccgctctctgagatgtgaggcagaagtaacttactgtccctacttggttggtagttgaggacagagatgatgacttatgtctgtcattttccaagatgttaaatatcagaggtgcctctacacccaaggaatcggagcctgagctggaacacacacagaacaaatgatgagaaagtgaggccagaatagtgtgtggagtattgttaccaaagtaacactgttggcatatgccgagaaatagaatcaaagcatgtcttacttgacaaattaggagattagctagcacctcaaccagactaaagcagatgatgtcatgctgccaaaactggaaggaaaagctgctcgttcacccagaacagaagtccgagaccacgtagagcaatacttcttgttttactaagtatacaaagaaattaattatttaattctagtctggccaaaactaggaaaatgtctaggaaatgtttctgtataacaaatagctctttagaccctgaagagctataataacatctagttaaccacgatggtgcctatagtttaatttactaggagaggaggggagtgtggaattaccataatgttccaacctcccagtagggcaccttcatcagtcgaaagtgtcttcttcaggggaacatcacacaccggggcctgttgtgggatggggttactggggagggataacactaggagatatacctagtgctaaatgacgagttaatgggtgcagtacaccaacatggcacatgtatacatatgtaacaaacctgcacgttgtgcacatgtaccctaaaacttaaagtataataaaaaaagtgtcttcctccctcttttccttaaccccttctcatactgtattcctttcttctcatgctttttctcaccttcatctttgcaccttttgattaaaaatgtatatacctgccccttctgtggttatctatgcatcgtctttcataaccataactgtcctctcataggaaaagagctcaacaaatattggccaaattattgagttatgattcccacaggagtttaattttaacaacagtctatgggtttgtatgagcaaggagtatttctgaattattattctgtttttatcatttagcagatttcctataatattaaaggtgatccataaatgctggtcacatttttttttaaaatatcaacagctttaaaaatcaggtgaaaatattgtatgtttacttaaatattatctgggccatcttcacattcatcttcactaagatttgcaaacctgtttactgtttgtttctgccttatgaattttctacaaacctagactgcagcctcaggaaaaagaatcagacctctaaacctctggaggtcatttttccataagcttctaaaggatacgtgtcagttttatagtcatcatacgaatctttgaaactgaaagaagtggaagaaattaaactctgttttttctgattttttttttcgtcatgaataatagaagattgtagaatttttaagcagaaaaactagtagaaaattctcttctgggtagtttaacatttgaaatgaaaacaaaatctgaattagagaccatgtatgttattcttttgttcactgagcatatatgagaaatgtgtgtgtgtgtgttagaatatttgtaacttacagtagctgaagtgaacaaaacatacatcctactgcaaggtttgatgtcaggcttagattatatttttgtaaacagtgcgctgtggtctgaatgttggtgtcctcctaaaatttgaatgttggagcccaatatctgatgtggttcgtatttagaggcagggagatggggtcattgggaagagactaagtcacgaagattctacccacatgaatggtattagcactttttttttttttttttttgagcagagtatcattgctgtagcctaggctagagtgcagtggcacgatctcaactcctgcaaccaccatctcctgggttcaagcgattctcctgcctcagcctcctgagtagctgagattacaggtgcctgccaccagacctagccagtttttgtattttcagtagagatggggtttcactatgttggccaggctggtctcaaactcctgacctcaagtaatcccttgacttggcctcccaaaatgctgggattacaggcattagccaccgcgcccgaccttcgcacctttaaaaaagcttgagggatctctcttgcctctccttccactttgacgatgctgcagggaggtgccgtctttgaggcagagacaaagcaaatcttaccagataccaaatctgttggtaccttgatattggaatctccagactccagaattgtgaactataaatttctgctgtttaaaaatccccagacaaatgtaatttgctataggtcctggaatgaactaagacacagtaataatagcataaaactaatgaccaagagattttgacacctgccctaacttgccatttgagggcaggcaatgctgttgtgataggcagttaacttctctgtgtgtaatctcgtcagtggcaaaacaaacataatcatttctcctagcctcccttactcagttgttttggagatcatttgaattcctatatagaaaagcacgttgaatgcaaataaccaaagaaatatttagagatttggtttattcagcaaatagagaaatatagtatggccatgtataagcaaattctagcttaagtaaaatataccataattacaggtgctgaaaatctcaaagaaaaggtgaattttatggtagcaaacagttgtaaggtctgggaaaggcgaactttgagttctggcgaaaggctcacatttgaattacgagaaggaacacttattccaggagaatgtaatgaaagacaagtgagagaaaaattcaggaagagaaaatgaaagggccacatcagaggataaatctgaggaagcaaagtgaggtcacctggtggacgcccttgggcagatgacagaaaggagaatgtaaattcgttctaagaggtaatggtaagttatcacagtcccctaagtggaagctgtgtatgaggtaggttaaggcagttatgtgtcataatttgtaaaagagttagaaaaacctgctatgatgttgtataggtagaaggcaatagagaactgaattaaattcacagcagggcagattaaaaagttgaaaaaaatgatagtgtattttcactgatggcaaaaagaaaggcacatgggagagaaaactttgatttagcaagcaatggttggggcatggaatgattgtgttggttttagatgttccacaagatataaacacattcatcacagaaaacagatattaaaccagggtacaaagattgactttccaggagcaaggaaatcctggaatgcaggcatgttggatgctatgacttccactgtgggttttcttaggctccattagacatttaaaagccagtggcttcataggtcacatctgtaatcggcacacttagaaagataagcagacaggatactcagtgggccagtagaaaagttaggatatttcttttggtaaaatctttatagcagacaaaacacaaaacgaataaaaaccaaaccaaacaaaaaaccctattctctggacctccaataacaggagagccatatacatctccaagacaacaagcttcacctagatgaatgtgaggtcacttcagctcagaaacccacataccataggagccattcccaagtaatgctcacgtggagttaaatcccagaattctcccaagaggcatcaggtgcaggttcaaaggcacagccctcacgagtccaaatctatggcctctcaaatgctataggttgttcattcatagtacccccagtcagatgcaatttaccaatcagggttattttcaccatgaacaatgctgtctgctaagacagctcatattttacttttatcagagttgtggagcccggcagttatgccagccaagataaaatattcatgtaggacaaaggaaggtttaatgatcttctcaagtgcaggtacatagtacgttggtctccgttagaaacccacaggcgactgcaatcacattagacaactgaacctcgttgccaagaaacaggtgaggagtcatgaaggaaccaaggacagtgtgttaaaggtgtgtttttggcatatgatagaaagccacgtcctgttttcgagctcactagaagttggcattacagctgatactgaaaaaggaggggagaggagcaaattaagagcagcagttcatacaaggaaaacttacatatctgtcatactttccatgctttgtctttcatttgtcatttcattttgcatgaagtatatcaactagaaaatatattttaaaaataattctatagtatagagactagatttctagtgctaacctgaacttaaagtgaactttggatcttttcatgattgtatatttttcttagagaacacgtttgttcaccagaaaactatggttagagttaagtgttgcagagtaaaacagctctactctctcccttcaaacttacctgggttcaaaatgtggactttgctattagcgtgtattgcatttagttcatcttacaaagttctgtggtcttaagaataagaaaaataataattaaccggattatggtgaaaattaatggactgtaactaatagtgtctcttatgttcatatatgatgtgtaatatggttagcaatacatatgcgtattttctgatatcattggtaaatccaggccaccagagtaatttatgtacaaggtaccttgcataaaggaacttcaagtacattttaaaaactatattagcaaactcctacattcaaataggaaaaaaaagttttattgttttagtaacatagaaacattgagtccattttgactgatgatttttttaatatatcataaaataaaaatgaactgaaattgccctatacttgctggctgtgttgaaattctaaaagatctttgtttttatggacgtttcccaagggcagagttctcagtaacttcacaatggtctgactgaaacagagtaggcagttggagaacacgacctggtgctgttcctactttcatatgaatcactcaaactttctactgcctgctctatcaaatgaggggttaatatgtattagattctaagcttcaaaggggatcaatatgaaggcaaactttttaaagtgtgacctattatccacaactaaccatactgcaaagcgcaagggcatgaccctccacaagcacattcttacttctcaaacaaactccaagtttgggtttcccaaaaccaccctcaggcttgaaaattcactgggactcatggaattcatgaaaagctattacactcatggttatagcttattacagaagaagaatatatgttaaacatcatctgaagaagagatgcctgaggctgtacccaggaggcttccaaatgtgcagcttctcctgcctgttccctgcggaatcaggatgcattgacctctgagcataagtatgcagcagtattcaggattgtcagccagggaagactgcccgggtttctgtgtccagagttattactgaggcttcactatgtaggcacgactcattgattaattgcccatatggttgaactcactcttcaggtcaactgacgtcatgtaaaccaaagctcccaccataaataacatggttggtctttctggcatgacccaacttcgcactaagattgttagatgtagttagcctcgccctgaaatccaactgtggccagctcctgctgtaaacgaagatataagtatggcaaagattctcctcccagaaaccaagcacaaagtccaggcatttctgaggttggagccaaattctttactacacatctgtaaacaaaatatatttccaaagatatttataaaaagaagtatttctggacctaaaatattatggagaatgaaagtgacaaaaaataggccgagcgaatgtaggttgccatggataggtgttgaaggaaaactagaaagactcaccagtgagtgggattgaatggcgttcacttgagaagttgaatggtggctttcccacgtactcctctgctacgcacatatttagagagcctgttgtgtgtctggcacagtgctatgcctgtgtggagtagagataggttgaatcatagtactcagagcttctgattgaatgtgcatggatgagaagatgaatatcacataacacatgaataatgtaaaatttcacttataataaggtcttttagggaacacttcatagcactatgaaggtgtggagtagaagaagggattgatgtcgttatactttaattctgcttccactgctgaaactgacttcaaccaactcgccaaatccatttgtaaaatatatagatttacattgtcacgataaacctgatcctactggagcattctacagaaacaaaaatgcaacatgcaagtcatgttatttcccgataacattagaagaaatgattcagtgcttttaaatcctaaataagttatacaggagtgtaacatccaaagttattttgaaaatgtaatctgatttatggactattttatttggggtattacgaacagaaaaaaaaaaagttctcctgaagattataacagcattaaatacatagaaaaaggtaatgttttaaataggccttcgagaacttggtgaaaattattaatttaagactactcgtgaaagtagtccatttatgcagttaacaccttgctctatgcacttttattcaaaattaagtaggccttccatttctacaaatggttggaattattatctaaagatagagtagtagttttatatggcttaaatgaaacatagattaaaaactgatttaaaaggtaagaaacagcatagaattcattttaaatcattgttataaaaccaaggtcaagcatgaaatattttaagcatttttctcaaaagaagagcctttgaagtttttattcatattaatgaaatcctgagggtttgataaggcccatcctcattctgtggactttatcaaagcaaaatattatataacttttactttgaattatgattttaaagaatggaaatagagagtcaaaaaattacttaattgacaaaaagcctccatttctacctctagtgagagatagctaagatcgaagtgatttgactatgttattaaaattcaattggacagtcacaaattgctatctttacagacacaaccatcaacacataatcactaatttttccaagaacacatgtgcagagcaatcttgtgcagagaccgcaccatgccgaacaattttatacagagaagtcaccatgcagtgtaggctttatttgattggctggaagccaaagcctggtcaattttaaggacggaagcaatccctgttacatatcacgtaatctctcactcagcaaaggtaactctaggtattttataaaagaataagctcttttctactctggcctggtgttgtatccttttcccccattgcatctctcttcacatttttacctatagaagctctgtcaaaaactgtctttgtaaatggatcatcacacctggtatttgaagattatgaagaatctaagaagtgtattaaaattccactcattcggaccatctgtgtccccaccctctgctctgtgaactccacctggccccaccacaaacctcacgtctacacagcgtagaaacagaacaggtgtggaagacgactctgccatttccagtggagtaatattaagcaaatcatctactatttctggacttaggtatcctcatatatataggtgggatatttgtccagaagttctccaaggtcccatctggcttggatttaccatcacagtttttgtttttcacttgttattccaaatataggccaatctctttaaatcttaggagctttgtttgtgtagttttgtttaacttgccaggtctttctcacctccctaattaggaaaaaccctcctaatgctaaaggcccagtttaaagattactccatttgtaaatattgcttgtaactctaccacctaggttgtatcaattaattactccctcctgtacaactttggcacttttttcatgaagcccatgtaattatcccatcattttacactaacttcgtagacaactttgtcttagttacttttatgactaaagagctgtgtcttagtcatttttaattttttttttcctgaagtaagtgtgggatatacaagaagccctcgatatatatttctaatcattgccatgccattacaaaaatttctctgtgcaaataaaaaaaattccaaattctacttgattctttgtacctgtcaggatagctaggctacactgtggtagcaaaccacctccagtctgagtagttacaagtgttcatttcatgactcatgtccatgctggatctgctgtggctcagttgcctgttctgttaactttgggccccagcctgagggagtagcctgtatctgtaatatgctcagtctccttcagagacaaagacaccatggcaaaggaaacacaggctttgaaagatttttgaggaaacagcataccctatcttcccagctttcactggccatgtgggcacttaggagttccctggggtgcaaacgtttactgctgctgcagggaggggcaccatagaaaaggactataaaatatggcaaattagaatacagtctgccatactcaggccccagtgccgcatgatgtggacagtcgttgcatttattacgtgatttccatttgatcctcatgcagttctcctcctcaccaattaagaactcatagggcagcatgttaggagtagtatgtattcgtctgttcttgcattgctataaagaagtagcagaaactgggtaatttataaagaaaagaggtttaattggctcacggttctgcgggctgtacaggaagcatagcagcttctggggcagcctcaagaaacttacaatcatggcggaagatgaagcggaagcaggtgtgtcttacatgggccaagtaggaagaagagagagagcaggtgctacacaaacagcttttatgagaactctatcatgagaacagcactgggaggatggtgctaaaccattacaaaccacctccacaatccagtcacctcccaccaagccccgtctccagcactgggaattacattttaatacgagatttaggtgggaacacagatccaaaccattccacagtatgatgtgaatgacataaaagtttggtaatgtttgtctagatataaaaaacaaaaaaaaattgattaatactgacagatatcatgaaactcagtagtagggagatgcttctgggattcaatatttatctcacccgtacagatttggcaatgcaagtataaagcaagaaaataagacaatgtttccaaagtgtcataataaatgcagttgaactctaaatcaaagatgtttacgtaataccctactagtaaaaattctacagaaagcttgtctttactcagaaagtcagcagactctaggatttcacatcgcatgacccatgaaaatgaaattttctcagtagaagaaaatggttacgctgttatatggtaaataacagttatgattaatgaagtcaggaaaattaaattcatgtttcaagcagtaaactgtcataggaattagcatactcagtcatctggcattgtaccaactgaaactcagttaatcagtatttctgttaaactcattaatgcctacagtggcaacatggcgattaaaaaacaagttttttgacatatgagcttatatcttcataactagcacatttcaccatgaaaatagaatttctgatatttaaacttttttgttttttatagaatatgcttttatttttgttgtttttattttgttctgttgttcagactagcaaattaaaattaggatgtgagtgtatttccttctggatgaaaaaatatagataatttttaatgcctcaagtttaaattgcaaagacagatttttgtatgcaatatagtaaaaatctatggttatttcttcttttacaaaatagctgtcgcagccttgtccattagttttaataatacatctttgttatattgaaagtaatttgtcttaattagaaacattatgaaaatagagagtacagaaaaatatttaaaaccatagcttcaagagtagtaggtaaatactcttgatattttggggtattctcatttctctcaagctctctgcatatgcatgtttttgtgtttatttccgaatgtgtatggctgtatggattactgggcctggacatttgtgtgtatgtatgctatgtttttccattgagcatcacgttctcaacattgttacatgttagaaatgctttgcgagtgaattgtaatgtccatataatattttactctgaaatggattagaattgatttaacaattccctgtttttgttatgtttagtaatattataatcaacagctcgatatgaattttgatcaccacttcttaatcgatcttttttttttcttttttaccccctctggagtttctcttactcatttcccccgctgtctcatcttcccgactcccttctcgcccactctccatccccctctcttccacattgtccagattctatatcataaggcctgacaatggagctaccagatttaggaatctccttgggtgagggagttccagtgcagggagatagaaaagctaagtaagcagaaatgaaactgcccataacccgtgcagttaagccactatgcctgtattatctgtatctcaaaagttaatacagctataacgtgtgccaagtaattttgaagttgtactgtttggatattcttaaacagtagcattaaaaagtcactgaaaatatgatactttaattcattatctgtgttcttaaaatcaaaaggaaaagaatttatctgaaaaaagactacaaaataaaaagggcagtgcacactactaaaatttcaccttacaagaattattgatcatattttggagttaaatgtattactcctgagattttaagaaagtttcacatgttttaagtgttcccaaagcatgagaattggtccatttccaagacgtgtttttttttttttattattattatactttaatagagtttatatatataagtataatatataactatataaagtataatgtaatttttctttagtatattatatgctaaatataatatacatatactttagtatattatatttaatatatttataatattttatatgttatgtatcatatattaaatatataaatatattgacatgatatatttaatatattaatatattatactttaatatattaatatattatactttaatgtattaatatattaaagtataatatattaatatattaaagtataatatattaagttttagggtacatgtgcacaatgtgcaggtttgttacatatgtatacatgtgccatgttggtgtgctgcacccagtaactcgtcatttagcattaggtatatctcctaatgctgtccttccctgctccccccaccccgaggtggtttctttactgaggcttatccaactgcacactgccaccttctacactagggaagatggtccttcggaggagcattgctcacaggggcacaaggtctccttcttttttcataagtgccttcttttttatttaacttatttttttcataatcactttcttacataaatattgattgagcatcttctagtaacaaggcagtcatattgatgcttgagaagtgtctgtgaacaacgtagacaaagatccttgccttcacagagtttaccatttcctgggagtaaataagaaaatacatttttaaagtaaattatagagcgtgctataccaatgcattacattacataacaatacctttttaaagtaaattgtggagcatgttatgaaataataagtgtcaggtgagaagaaaaattgatcagggtatgaagatcacaaagaaaactcacagctttctcctgagcctcaggaatgaatccccaaaaggaagaaccaacaaagaagactgaaaacatgcaatcgtgaaggaagggaagcagcatctcagaggagtgtccttgaagccaagggacgcgggctcagccacctgctgccactgctgcttttggatcaagaatgatgaggtcagggtggcaggcattggatggagtgacgtgggttgctcgactgatgacatgaggacgggagatgtagttggatgttggggacgaggtgatgtcaagtcaagaacactcttggggagccttgccataaagcggtgcaaataaatggagcaatatttagtgaggaaggtgggatcaagataaaatattttaaaatgagagaaataggaacctgcgtggatgctggagggattgattctgctgagaggaatccctggtgggttacagaaagcggagaattgttgaagcgtgcgcttggaggagacagaagaggctggaatggatcctacaaacctgtgcagcgggagatgcagacgcttacctgaccctccatctctcccgtccctcacagcctccaaaggctcctccccacccccatcaccattcatcttggcctgcctcagtttccccttggtcactttgatgaagccaggattctgcttttgtgaatgctgagatagctgacacgagtaagtcctctactccatccctcctcccaccttcctcaatccctaacaccatctactatgttttctggaatttatcgtcaactgtcagcatcttctatatcccagcttattctctgaatgcagccctgcagccctaccctcttcccgacgtcttgaccagcagcacaggggagtgtggttcactgtacatgctcatccacttggctgggagtagagagggtgtcccttatcctgcactgcttccttcgggccattctcccttgctccctacaaaccccacctctgattctggggcaggagttcgctgcatccactgcctacaggatggttaccacctccccacatctggtgcatgttcctgcgcctccattcccagtccttgaatttagggacatactctccgtacttccactagattcttgtagaatcaagtattcttatagagtatttgtatcgatggtttttgcaacaacctgagcctctgtttcttgaattccttttctgcaaagatctcctccagtctgcctcaaccattcttatttttcatacaggtccagggaacttgtcctcaccggtgattgcagcccctccatgctctcagttttatgaattattctctctaacctgctatctctctagctcacatattcttcaatgctcaggcccccagtacttctaccccgccagaatctctgatccatggagcccactggctttgcatggccatgtctgctcccacccgaccctcctggcgccctcagtctctcatccttagaaccacgtgttctactcacacctgacttgtggtcacttccttatacattccctcttcattcctcaccttcttgttctctctctttcctttaattatttatcttctgcttttttctcttttcttctgctattcacccttttctttgtttcttattgtctatcacctaaagcttaagttagcaatggatgtttttttctccagtgaaagtagagacaaccctgccctcccttggcctgcagcagggagttgctgctcaaggtgcagaggctcacctttcagggaccacctgatcaaacagagccaaaaagtctcaagacactaggtctttctttttgtactttttcccttgagataattgatgagtagaagtgcaatactcagcactgagaaattggtagtgctacatatgtccatgccaaaagagataacaaaagtggttcagggatggccatttggggaatggatgggctatcaagttggaatttcccacttttatgtgtgtaatgtcaatatgaaaagaccagtccctaaagactttgtgttgccctgatatgcacccttgtctagatgcaaattcattatttcaaatattctaccttctagcataatgagcaggctcatgctttgaaaactgatatcataatatatcctgtcacaaattagctcctcagaaatcttattttacatggaaaacaattcatctttaatgatatctagaattatacctaaatagatttgaaatattccttctacattcatttctacaaattgttatgtgagcatcactgcaggaaaaacacatagatatttatctaagctgaagcacttattatactcatctgttattttatataacaacaagttaaaagaagtaattcttatttcttttaaattagaaaactttaaactctgtttcctgtgataataatgctgaaataaattctttcttgagtctgtagagtatctatcattttttatccttcagtaacttttgagctttgttcctttgactggactttcacacactactaaggcacacccctgtgatgtgtataaatgcgaatttcaatttttttattgttttatttttttatgtttatttatatttattttttgagacagagtcgcactctgtcacccaggctggagtgcagtggtgcgatcttggctcacctcaacctccgccccccaggttcaagttattctcctgcctcagcttcctaagtagctgggaaaacaggtgagagccatcatgcccggctaatttttgtatccataatagagatggggttttgccatgttggccaagccggtcttgaactcttgacctcaagttatctgcctgcctcagccttccaaaatgctggaattaaaggcctgagccaccatgccaggcttaatgcgaattttgaggagttgaattcagtgtcagtgcttacaggacaaagagaaaaggcaaggatagtagaaagagtcaggggtgagaccctatggaaaacaaagctattgaaaccaaaatagagaacactgtgcacatattgattctatctttggacttacctattggttttttattcttttgtttggagcctttgatataaagaaaagtgtaaacagtctcaaaatttgcctatacagcagacacttgaaattcataagggatatgccctaagaatggcgacatcgcccaaatgtatcaaaaagatatactctttgctgggtgcagtggctcatgcctgtaatcccaacactttgagaggctgaggctggtggatcacctgaggtcagaagtttgagaccaacatcgtgaaactaaaaatacacaaattagccgagcatggtagtgggtgcctgtaattcccagctacttgggaggctgaggctggagaattgcttgaactgggaggtggaggttgcaggaagctgagattgcgccactgtactacagcctgggcgacagagcgagactccatcacaaaaacaaaaaccaaacaaaaaaagatatactctgtctcacaatatcatctttaaaaacatatcatttctcaaaagatatttgtacaagagcttcataaagattgagtttacaccctgtgtttcctgtgccgatcctgatttcagcagttgacaacatcactaaaatcgacccctccctggggacttcgaccttgttccccaggtaggctccagcagacaggcccaggaatcactgttcttttcccatgtggagcattagctgaactcatttgaattgcagataccaatttctgctgaagtcgtcattctaaccgtcgagctactcatttactcatttatttgatggattccaattcagatgtaactaaaaggagtaaccgccagaaggagcagggttactttctgacatttaagcaaggactccctttcgtccgtccttccttggcgcctgtgatggcagctgcgggtagtggaccccacctctctccacttcatctccccaaattctggtgcagaaacttccttcccagtccgccctgtatctttgtctgtgcacattcacatgcacccgtgttcctgtggttttgtttcgttttattcctcttttccatcattttctcatcaaccattcccaggttgatttttcattcaaactaagttaatgtcatcgtttaagacacctccatttatcatcctaggcttccttgtctttcagtgtaactttctgttacaaaagtatcccttcaactgttaaatggaatcttgtatattgagggccaaaactgcatgccactaagtttaagtttatatgagcagagaaccttctgtatgaaagtccattattataagattaactaggagtatatttttgcaatagtatatacatatatatatcatatatatatgatatatgtatatgatatctagatatgtatcttctttatatcactctttagcatttctggactgaaaaaaatgtgtgctttataaacatcctttcataaagtaccactttttctttaaaatcgctgctaatcatttttttctacagtactaaatatttgacaattataattagacacatgtagttcaggaccacctaaaagaccattgcattttcagagatcagatcacacagatggtgcaaggagcataataggatctgaaatgaaaaatctggctttaaaattaaattccatctattctctgcactttagaacagtgagggaaattgagcagttcaaagtacatatttacaaggagcagcacaaaggtgaaattaaagtggtattgagtaaattaagtaacttctcaggcttttgctataaaatcggaaagtataaatccagatcaattaactgaattaagtactcagagaacttaagtaactattagttgaaataactcctaattgtgttttaaaaaacaccaactatgcctagagaaggctgagaaaaaaaatgagtctttttctagttactctctttaataagattgctccttttgatgtggtgatctctgttgttagtgggatcgcagtagaatgagctcccctgttgggcagaacacttgggtccagctgaggatttgcaggtattaagggcaggatcaatgtcctgacaacttctgattgttcctgacattggcttttgcctgtaaaaaatgccaacttctcatccaccacatacagcagtcacagcaaaaataaattcaatatgagcactaagtaagtatatatatttagagagagagagagagagagaaatatcaccaggatggtaagaagattagacaaaataaaaacatgtgtcaggaaagaagtgccccatccaagatacacagaatagagatgaataaataaataataaataaaaatcattggttgttttgaagccaagaaaatatgcacttacctttatttataaggagagaaaacggatagagttgaaaagtcagactagctatagggagcgcataatgggagcaaatacatctaaatcagtcaagatgaggtttgatgtgcaattattggcacccaactatatttcctaatcacttatgataaaaaggaacatatggagctggaactgcagtgtcagggattgagacttgctataaggaagcattctgtattagtttttccatggctgagtagcaaatgaccagaaatgcagcagctgaaggcagtgcatccgtgttttctcggggctccatcggtctggaatcaaggaccccttaccccagtcttctctcagggcctcaagaagcagcagtcaaggactccttcagtctgtgatctcaccttaggctggaattatcttccatactcatattgatgttggcggaactcagctccttgcaagtatagggctgagatgctcaggaccccaaaactgcccactgctcgcagccaactgtccctccccacactgggcagtgccttccgggaggccagcaggaggggaccacttctgcttccttctctgacttggaacacttttaagggttcctctaagtaggtcaggttctcccaaatcaactgcctttggattaacttaaaaatcaactgattagggacctttctacatctgcaaaatgtcttcacctttgccctgtaatgtaacataatggtaagagtgacaccgcgccacctgtaaggttcaggcattattggttaaaagccagtcacaggtcctgcccacttgcaagaggaggagacctcaggagcatggaggtcctcttaggatcctgccttcccccaccctggaagggcttctaaacctgagactagattgctaagaggcatcatctgatctgctgtggatctggaaaattcatatttaaaaagtaaatcctggggccaggcgcagtggctcacggctgtaatcacagcactttgggaggccagggcgggtggatcacctaaggtcaggagtttgagaccagcttggccaacatgatgaaaccctgtctgcactaaatatacaaaaaattagccagacgtggtggcaggcacctgtaatcccagctacttgggaggctgagacaggagaatcgctagaaccagagaggcagaggttgcagtgagtcgaggttgcagtgagtcaaggttgcaccactgcactccagcctgggcgacagagagaaactccatctcaaactaaataaataattaaataaatccttaggctaaagaaataaggtgagttaatgataataactgctaatgtttgtgaatatttattttaaatgtcaacttaatctaaagtcaaacatttcatatgctctagcccaattaatccacccaccattcctgtgaaatactttctatgcttatctgagtttcacacgtgaaaaaactgagaggaaggttattttgagtaactgtcatcttcttgatcagttggggctaatcaaaacttacatatgtttatctatttcacatgtagagtcatgcaccacataaagacattttaatcagctatggaccatgtaaataaaggtggttggataagattctcatggagctggaatattcctatcacctattgacatggtagcgatcataatgccatagcgtggtgcattgtggacgtatctgtgatgatgctggtggcaacaaacgtatagtgtgttatataaaagcctagcacatacacttatgtaccatgcataatgcttgatcctgatcataaacaaccatggtactggtttatataattactatactttttattatagaagtctactgctgcttattattttttttttaattttaactgtaaagcagtcttaggcagctctttcagaagatgtccagaaggcattgttctcataggaggtgacggctccatgggtactactgcccctgaggagcctgcagtgggacaggatgtgaaggtggaagatagtgatattgatgatcactgtttaggcctaggacaacgtgtgtgtttgtgtcttcatttttaacaaaagaagtatagaaagtaaaaaaaaaattaaatagaagaaagcacatagaataaaaatataaagaaataagatattttatacagctgtacaaagtatgttctgagctatgtgttattgtaagagtaaaaaagatgaaaaatcaaaaactttataaaatacaaaatgttacagtaagctaaagttaacttattattgaagacaaaaaaatgtttaaatgaatttagtgtgcctaagtacactgcatttatagatcccgcagtagtgtactgagatgtcctaggccttcataatcactcgttcactgacacccagagcaacttctggtcctgcaagctccattcatggcaagtaccctgtacaggtgtagcattttctatcttttatgctgatttttcagctgtaccttttctgtggttagatatgcttagatacatagatatctatcactgtgtaaccattgccttcagtattcagggcagtcccatgcagtacaggtgtgtggtccaggagcaacatgctgtatcgtagagcctcagtgtgtggtaggctagtccacctaggtttctgtgagttcactctacgatatttgcacaaggacaaatcagcaaactatgtgtttctcaaaatgtatctccattgttaggagatgcatagttgcactattttcctaacggtatgtgttttctaattcccataaactgtcttcctgccttcaattcaatgtctacagatttgccttatagttgatacttcttgcttctaaatatatgtatgcattttaaactataatatgaaagtctaatcacaggagacctttattgtgttataaaattatacatcaataacctttgttaacttttaaagtttgtgcagtatctgcatatcacatctttaaaatcttaattcattaaaataaaaatcaagcattctgatggcagtttttaaatgcacagacaaatattgacaagaattttagaaaaaactttagttttaaattttaagagacatttttcccttcaaaagacaaaaacaaaaacaaaatctgttctgattcttctatgaacagaagtggcagagtatgtttcgctcataagttctgaggtcacatgacctcattgtcaaggaagatctgtatttcagtttatcagaaataaaactagtgaggctgcagttcccgacaatgatgaattcaaatagtgaatttccagctgcatacccaccgttctccttccatctgcagatgggaggacacccccttgccttttcaaatgacattggcctctagttattactttcctaaaaatccaatttttccctctgtgacaattctgctaaaagatgatgaagttacggttagtcacattaccaaagagattgctctctctgaatccatacatcaactccctggacctcctatggatcatagtgtaaaggttctagaattattctttgtcaataatttgttggtgagtgaggtgtatgtgtgtctaccagatagaacttctgggacttcctgaagtattgtcattgacttgaaattgatccaccaatgctgttattaattttccttgactcactaaatatcacccacccatccgtcaggaacttgctctcaacagagattttagccacaagccagactcattcttcaacacccttcttaaagaggaaataaaaataagcctttctaagttaatgccaatattgtctttttaaaatttttaaagtactattcttatgtatataataaaaatggtaggaggggcaggtttagatggccttgttgagagtgggatggaaatttaattatattaacattgtgccattgtaataacaatgactacatattatcagtgctggatgctagacatttggccgtttgagtacattttctgagttcctcatcattgttctcagataaccttgtgcgcatgcaatggaaagttctgctgggtgtaaattacgttactctaaattgtactcacaatatctgtccctctttactttcgaaggtacattatatccatttgattcctaaaacaagccttggaagtattactttcatgcacattttgcagatggtggatctgagaatcaaatgctttaaaacatttcccgaagaccagccacctcctttcagtgctcaaactaggtctgtgttccacccactgtgggctcccgtcactcactccgtggcctgtctctttgaaaatgcattccatggtatcctataacaaatttctctttaaaatattcaaatattaaacttccaactggatgcattgacataaaagcatcgtgaataacttgttttttttttacttttatatagtttcacatttttctcatatctgtctcatgtttcatgtacacaaagtccgagtgtaatttgtcattttgatctttggctggctgttattcttaattactctgaaaccaactttgactttaaatatctgaaatatctttgcttataattacatactgtaagcacacaataaatattcagtaaataaagtcttcaaacgatttcgttcaatgaggtaaagattagtataaaaagataaactcattaacaaacaacgaaagtatttttagtggagtagtttatcagcagatgattttgtgttaattacaaaaaaatgggaaagcaaggttttcaaggaaacaaacaatttacaagccatgacagtgaaaaattgagaattgattccattagatgtgctatggaatcatttattcaaactctctaaagaataaataaaaagagaaaacgatactgaaatagaaactcattacaacatttatcatgtgcaaaatgtgaatactaataatccttacttttcagggttgctttagaaatcaaactgagcaaactaaacaattgagtgagctaatgttgactttttgtagtttcaattctaggaacatcttcagtgcgtttttaaaattttatatttttatttgtaatgtcaagtttgtgaaacaaatgatattaatcctatattcccatttattgtagcagccatctgctaatgtatttttgaacactgacattccaactttttaaaagacagttttgaaatcaaatattaactcttctttttttttctgtttcccaattttaatcttgacacattttttgcaggtttctcattagtttggttttagtttcaaatgctctttgaaatgcaacataatttatgagtgttctaaaaaatagaaactctagctgtcaacatcttcttgatgtaacttccatataggcaagagatttatgtgttatttctactactgtgtccccaggatttacaatttctgacctagatctacaattggaacccacttcttccctagaaatttagccaaaaaatatttaatactagtaatgaacaatgagaataaaatcatttaacatctgtttaaaatatagtcttgagactataagacatgcacagccaactgtcaggatttttgtttaagtatacattattagtggtattgatatgggtatctaaaacctaattgagtcagagtgtaccaatagaaactactggaatgaaaagtgaaagaacctcataagaagattgggaattagttttgaatgtttaacagagaaatggacaagcagatgattctacaagaggcttggaaaatgggaatattacaatgatgctaggaaaacgagtttttaagaaaacctgaggttgtttgacaaggagaagagatcggggttgaattaggcagaatgaaggcatgtgtgttttccagttacatttagtgtgtgttttattaactatcagaattaagaacaagggtatgcattagaaagaaaggagcttttaactcgatatacaaattgatgctgcaacacgatggaaaaaaactgcttttggaagcagtaactttccttttctttttggaggatcagctaggggaagatcatcccatgggaaaggctttgccgtggccagtgtggccaacccaagggccaggacccttgaggagctgctagcttgatgcaaagtctcggtgctttgaacacagatcatgggctgatttgcacgtatttactaattttcattgtctgtggatgttattaatgtagctcagttaaagctaggagggaactattgtagttttgatattatatattataatcactaggttctaaaattagaatcatattcatggtttttttttatttgaacctctaaaaatgtgtgacctgaaaaactaggatccagttctaaaatcctttctagtgctaatatttggtgattttgtgataaacaatttaattgatatatgtgctttgtggaattttacaagtccctagacatccccacaaatcatagaagagcaatgaaaagggaatggggaatgcagtgcttggtcttgcaagtgaaagaatgtcaaagattgttttgttgttttcttcttttctccataaaagcaatcaaacacattgcttgaggttgagaaccacataacgaaagcatggttaaagaagtccaaaaatgcacttgatgccaatttattttgccaatctatgcattttttaatttagttttaaagatagttcaaaatcaagctcatgaactatttaaaacttttcaatataaacctttccaaacaagtttattgaaattgtatggaattcctttgtattacatacataaaaacacaatttccaccattttatcgatgagtaccctcatgagggggccaatagtgccaggcttcctggaaaagttctatttaatacttgatttaacatcaatcagtgtagtttagtgtttgtcctggaattttgccctaagactcatgtaccaaagaattgagatcaccggacagctgcagtggttcatgcctgtaatctgagcactttgggaggccgaggcaggaggatcacctgagttcaggagttcgagaccagcctgaccgatatggtgaaacctcgtctctactaaaaatacaaaaattaatgggcgtagtcacaggcgcctgtacgtagtggcaggcgcccagctacttggaaggttgagacaggagaattgcttgaacccaggaggcggacgttgcagtgaactgagatcctgccactgaactccagcctacacgacagagccagatagattccgtgtcaaaaaaaaaaaaaaaattaaaaaaaagaattgaggtcactgtatagtgacctcaatatcctatacactagcaagtgcacacacacagatatatcataaactcacacctatacatacactcacatgttttaacttgaaataaggaggcatgcttgcattttgattgaattacatgaatgcatttcctctaccgttttgttttgcctatattttttattcagtcaatgatttattgaatgcctattatgttcagggcaagaggtactcttgctactaacacaataaaataaagtacaacgttatctattttgcttatttacacactattattctccctcagcatatttgtgcactagagttttcaaggatatttctgttaacaggacagcgagatgctagttggcacctcagcctcctgcgtgagctttgccattcttgaacatctgtttcaccatttggctaatttatgctgtctctttttttttcaaaggttcaaacatacagaagcatttagttactttatgaaggccctttgatagcttaggcatgttgagaaaacattaagtataaaggaagcaagctgttcataataggtctttttaacaattaagaaaatattcattgaaagtataggcagagctattatatattaaaaaatcaacccagaggattcctagaaacataggactcttaggagcttagctttgacatgacctttaaatgcatccttcaacatctcacccaatgcttcagtctccaaatatccagagcagaagatcactgcatctctgtgaattccttctaggtacctactacctcaaaaggctgttctgatccttagaaactgccgcccgtagaagaggccataatgttccctccatttagctgtgcactttggtctctagtttggccaccagcttctctgggaacaaatataaactctctgagcagtggcagcactcatgggtttaacagcaagcgaagtgctttaaagagacttgttcattctccacaacagctcccaaatgaaggagatagattcttttttttttttttctgagttgaagtgtcactcttgttgcccaggctggagtgcagtgggcaactatatatatcatattaatatatataataaattaatattatatattataatatatatataatatataaaatcttaacatatatttatattctatataaatatatatattaatatataaatatataatataattatataatatataatatattatattataatatataatattaatttattatatatatttattttttattatatataaatatatatggagactgtatatctagagagagtatatattaatattatatattctaattaatagtatatataattaatatatattaatagtatatataatagtatatataattaatattatatattaatagtatatataagtaatatatattaatagtatatataattatatattatactatatattaatttattacatattaatttatttattatatataaatatatagagagagggactatagatatatagactatatatatctagagagagtatacatatagactatatatataggctatattatattatatatagcctaggctatatatctataggctatatattttatatatataataaatatatataatatcaacatataaatatataatattataattatatgatatataatatattatatataatattaatttatagatattaattttttattatatataaatagagagactatacatatctagagtatatattattatatattataattaatattatatataattaatagtatatataatagtatatataattaatattatatattaatagtatatataattattatatattatactatataatatcaatttattatatattatactatataatatttattatatattatactatataatattaatttattatatattatactatataatatttattatatattatactatataatattaatttattatatattatactatataatattaatttattatatattaatttatttattatatataaatatttatatagagagggactatagatatatagagagactatatatatctacagagagtacatatatagactatatatataggctatattatattatatatagcctaggctatatatctataggctatatataatataatatagcctatatatgtatagtctatactcttacactccctctatatatagtctctctctatatatataggctatatatatagtgcgtatatatagtagagacagtgtctcacgacatcacccaggctggtctggaactactggactcaagcaatcctcctgccttgcctcccaaagtgttgggggttacaggtgtgagccattatgcccagacttgtgaatttctgactgcaggttgtactatatatttctgtcatagttatctatccataggaaggcagggtctgtgtctgattcatttgtattctgcaatacttagtataggactctgatatttgcggctgttttctaatcccaagttagaaattccagtttctgctacagctttcccaaagccctacaaccgtttccaagtcacactaatcaatacatacatatttatttatgataattagttggggagggcatcagaagtccaagaagccagtttagatttcaactcatgaaaaataagaaataaattaaaggacatttatttgaaaaacagtatattcatctgtgcatttccaagtgacagaagaaaatgaaaactagtcctgtgaggttggaatgaagctgtggcaatagaatttcctgcgactatagagagggaagcactggttctttgtcagtggatagtgcagtctgagaaaacaaagatggaactgataaactgggaggagccaggaggattttaaggagagggtagttatgtgttctcaacctctattactcttcctactcaagagcagacatccctgtgcctatgtaggatgggattttcttacaatccgcagaaaattccacaaacgctagaatttctattaagacttctaaacttacttgtcagtcatttcaagtatcattattggtaatgttatcttgggggctgtgttgttttttaaatgtctctgcatcctcaggatctcacatcttgtttctgctgttcagcattaggtcccaggaggacatctcttctcttataaatgcctgtcatatgtgacgtaggcagtcctttgagatcaaagtgcatgctacttcaattttctgcagaccatttagtggcttaatatagctccagcctggggctctgatgtagaaatgaatactagttgcaatctaattttcttctgttgttgaagagattcatctatctaataaaatgatattacaaagggttgaataagctttagctatgcacatctattctggaataattggccaatgttttctttgaccacagactgtgaaactgatgtgaacagatttttttttttcctttagtgactacactttcaatttttgcatttaatactgaatggtaatctactcaatggtagcgttcttcctagctcttcatgttgaaaatcacccatgggcatcaattgacccagcctggccaccaagaagggagtaacttcacttaaagtagctaattaaggatcttagttctgttttcttttataaaactttttatttttgccaactttagtgcattgagatttaactaggaaaataatgtcctgaaaaaaaaatgttaaagaactgctttagtcaagttatattaaatacttaacatttaaatattaacatatttaattgagttataaaattatttaaactgtgagaagaaataaataaaacactaagattgtgcagtgagaaaatacatttttttgccctgaatttcattgtctcttgaaactctgctaatctgtttattttcccaattctaaccatattgaacaaaggttattacaggaactcacgtgtctcatgttgtgaatgtgtaatttgattcaggtcaaataccatttagtaaatataaattacttaaatatgcttcaaagaccaagcttcaatatcaccacttttctgactcactccatcctagttcttgctctaaagggtaagatgtggcttaaaattagtatatacagcaacaatctctgctacatctcctctacagtttccctattaatgcagaaattggagatttctgcattggagaaattttccatcacctaagaaaacatctttgtatttagacccttgggattcccacaaggatatagctagttcctcatagatctttgtcaagtaaacccaaaactggcaaactgctttgacttgttacaagcttcaatcagttttttaatgccacattgtgaaataagagcagataaccaaatattaaagatatttaaagaatgtccgatgacatgatcaaaataaacaagtggaaaaatctataataaactgagacaatgaatatagtaagaaaaaaataacttcacacctttcaaaggataggaggtggttttacataggtaaaagtttaaaaagataattaagaaattagagacatagaaaatcaataaacaattagaaaaagctaatgaaacagaaaatgaggacagtagaaatgatagaatcttatagaaataataagagagtcaaggtcttaatccaaaagttctattcctggacccatattgttcctacggagaaaatatgttgaaaaaagtcttatcaaagccttcatggaaaaaacgaatggtacagaggcactaaaggtacagaagaactaaggaacagaagaactcctagactgaaaaattactcttaggaactcacacaatcacccagagttagccaaatggtggggttaagggtggagccatccaaatttctttttttttttttttgttaattttattatactttaagtttcagggtacatgtgcacaatgtgcaggtttgttacatatgtatacatgtgccatgttggtgtgctgcacccattaactcgtcatttagcattaggcatatctcctaatgctatccctccccgctccccacaacagtccctgaggtgcgatgttccctttcctgtgtccatgtgttctcattgttcaattcccagctatgagtgagaacatgtggtgtttggttttttgtcctggcggtagtttgctgagaatgatggtttccactttcatccatgtccctacaaaggacatgaactcatcattttttatggctgcgtagtattccatggtgtatatggaccacagtttcttaatccagtctgtcgttgttggacatttgggatggttccaagtctttgctattgtgaatagtgccgcagtaaacatatgtgtgcatgtgtctttatagcagcatgatttataatcctttgggtatatacccagtaatgggatggctgggtcaaatggtatttctagttctagatccctgaggaatcgccacactgacttccacaatggttggactagtttacagtcccaccaacagtgtaaaagtgttcctatttctctacatcctctccagcacctgttgtttcctgactttttaatgatcgccattctaactggtgggagatggtgtctcattgtggttttgacttgcatttctctgatggccagtgatgatgagcattttttcatgtgttttttgactgcctaaatgtcttcttttgagaagtgtctgttcatgtccttcacccactttttgatggggttgtttgtttttttcttgtaaatttgttggagttcattgtagattctggatattagccctttgtcagatgagtaggttgtgaaaattttctcccattttgtaggttgccttgagctcttcctattccgccatcttggctccacctccgagaatggagccgtccaaatttctaatctgcccaagacttttgacaccaactacacgttctgtggatccctaaaccaccatcaggtttgataatttactaaaaagactcaaagaactctctgaaacgtattaccttcacatttgttacatttatatatttgtaatacagccaggatacatttaaatcagccagttttggaagagacgcacagtgcagcttctaccccgtttctccccttaagtaccgaggtactgacctggaacaacacacatggagcactgcctgccggggaagcccagtgagtctgccccacttccagggggtatttggggttttactgtgcaggcacaattggttgattaactgcagacaaggttaaactcagtccccaccttacctataagcagtgagtaagccacatccacagagggtaaagggaagtcatggaatgtcagttggaagagccctagatacagatgagaatatatggacagagggggccttaggagcaattctttacaaaataaaagaaaaaaaattttaaaataactgttgatagaataggtaaaaaataggtatatatagataaagcaatagtaaaattgaagacaattagaaatgtaaggaaaacaaaaacaattttaagaaaggaaatcaaagtataatattttttcagtagtgaccaaactttacattagtgaccgtgtcaagagttaaatatttaaatccttaattcacctgaaaagtggtgttcaaaccgtataggaaaggtgaattgaaagaataacaacagcaacaaccaaccaataatacataaatttgatatttcacaaaataggattatagacttggtgtttacaactacacttcaaatcaaagtttgggagttaaagaaaaacgtcttatattgtttaaccattttgttttatctttaatgagcctctcttttccaagtttaccaagagaagagaaccagggccacattttaaaaattatccatgtaagtgccaacatagaccttatatatatgtaaccagtcagaaagattgaagaaaaggataatttatttttaaagttgtcccatacaaacaccatcctgtgagagacacttccatgtgttttaaagaaattattgttcaaagtatcatcaaaattatgaaaaacaaaaaagttgattaccacttaggacacaaaaaaagtgcttcttcattgaaaaaaattctgaatatgaatgaggaaagggctttgttatagtaggaaaataagatagcattaataaatgatttgtaaactgtcatatttatgatataaaatatggcaaaattaaaatataaaaggagttgaatgcagtaaattattttaggaggtgaggaaatgccgttgtatataaaatggcccagaggcttagaataatgttttccgaatagaaatctgaaacataaaataaacagatatcagtgttgtaatgacaaaatgcagatattatcaacatgtgtaatatggttagaattacagtacggacaaaaaaattcttgattaaaaattctttggacaaattaaagtgattatatactttcctgaaattttaaagagaggaagttgatcgtttgacatgctccctgtagtgggaagttgtttttgaaaaaataaaaataaaaatcagaaacattcaaacagctgccatgaaatggaaagccctcactactttatagtatcaacttagcagctgacactttaatataaaaagaaaacagtgtctatatttctcaattattgatattcacttgttaaaatatttaataattttattgaaggaaacgtactcctatttgtgttgcttatgcaatatgggttttcttcttggattctccaaatagatgtttctacgtgtttctataaccatacaaattgatttttattttatttttaataaggcgaaggtatttctaatctggatcagatggaaagttaaaaatctgatcatattttagttatcagaagtcatcatggtgtaagtcctatttttgtttcgttctgaaatacagtcatgaatctatagtgtccacggtccttgaatctcagtttcgttgtaagtacttgaaatcttcgactccttcaagaacccatgccatcattgctgtgttatttctgtttttgtttttttacgtcttgaaatgattttgcttcagacatatacaataagacaaaaatagtttaaaataagtgatgctatgcaacagataaatgtggatacacatttagaacaagaaacaaaaaatcttatcttacataatcgctttataattaaggcaattcagagaaatatagtagtttaaaataattcaattgagaaaatgtcaccagaaaaaactaaatattttagacaggagatttgcggtatatattttgaacaaggaacatcattgcgttttaacggtaaagattaaaataatcccgtgtactcaggaataagggaaatcaggcagggaagcgcaggacttcaggtaccaggtctggacagggcacagcttattccatcccacgtgactcagcctccacggctgtttgcctttcttaattttcagaggctggcccataaatagccctaaagaattactgtttgcccacatgcacataaggcaggattccacacatgagatacccagtcttgattaagaagggctggtaacagtgataagagcaacgcagagaaggacagagatttttaaaaatttaccaaaaaatgtggatggtggcaacacaaatgtacaaaacctaatacactctgcaaactttccaggactaatctctggggggtattttaaaagtcttgatatttctgggttaccatattgtatgacctgaatcacaaagatgctatgttatatgaacaaggatagcagtagctttccagattatgatgggcagcatttcacagtcccgcgtgtgagcaaaaatatcccaaatggctatgtgttgtgctacccatccgagaactgtatttggaaacctattctttttcaatagtaaattcattggcattccaaacatatatcctttgccggtaaagattttaatttgtcatagattccttttgaaggaaaacccataagtagtgcaatgaaaagctataatattagagaggacatttgggatattccattgctgtagtgagcacagaggcatatgaaaacaacattttcctccagcctgttctccaaaattaatttttaagcatctacactgtgggcttcagtacctcaatatcatgtttataaggaatctcctggatgtttccttatggaattttaatatagctttggtcattgtgagggcagttccaagaatcatttgtctctgttggaaagacgagtttgcaagtgctgttaataattccagaaggagacagatggagctgtccgaaatgcaacatgccacagctccccagggcagctcccctgacgagcaggaataactaagagcagtattctctcaaaactttgttttttttatttaactttccacatgcttttgtgaaaaatctatccactcatcaatgtagagtctctagataaattgggtttcttttgaattgtgaaagcatttgtgaaatattgttaacatttaattctgaatggtattggacactcaatatttgattcctttcttctggacatttccaacacccaaaccctgttcgcgcattaagctgccttcagagccaacaagcagaaattttttggtgaaggaaaaggtgaccatgtgttaatcgtcctaggtgaactgtccctcagaaagaacttaagaaataattttaggtgagaggaaggaaatatagattttattaacgtagtgaacctcgatgaagacacacttaaaactgtcattaggcatgcatgaaaggagagcttaataactcctaattattttatttcagttagcattttactggcgtgcatatccattcatcttgagattaagttcttttgaataattattatattttaataaacacaaagttcagcaggtctgggaggaattggggcattttttttctctctgttttctgagtgtgaattcctaggcacattgatattggccatggcagagcattaaatcaatatttttctgccagtgttgcttgcaaacaatcattcttcaataataacttattggagggtttctacatgccaggaggtctttgagatactaaggacataacagtcttcacaactccatgattctcagttgcacagaatgcagagcttagagaaagaaatggtgttaaaacaatcacagtagtcaacgtataattagaacctgggtatcatctgattggaagcggtccaggtaacgtctccttgagggaaagcaacctctgagcagagatgtgaaccaacgaccaatcattcggcaagtgaaggctgacgcttagtttgccccagagccagatgctctgtaatgtgactaactgtgctgatttttgctctatcatgtatgatcacctttagaaatttcacatattttacctcaaacaatccttgttccacttcataaatcagcttcatggaagagaaactctggagcatatagtatgaaatgatatcagagaaattactctccttcactttagggtcaagaaaacgggcacagaagaaaattaaggtgatttgtcaaaagtcagcccaaaaagttattagaagagttagacctgaaatccacttaccttgttaacaaaggaaaacaaatgtataaacaaaaaacatatgagcaaaatttttaattttccttgaaatcagttttttttcaaaggagaaaagccttcattttcccaatagatctatgtagatagatgttcacataacagtgttttctaagcggattaatattcaaaaagagctttcttaaaacgaacttattcagtggccaaagaagtgttggaaaacctcattcaatattcctgtcttggagaaatcacataattggggtataatgagaattttgagaactgctacaggaagaaagctgattttcaaccaaatatttctcaagcatgttaagatacgaggacatttgcatcatagaacatctctaattcttaattcattctacatctttttcttcagctctcctgaggggcccatcattattctaagtactggaggttacagcagggaaaagagtagcaactctcccaaactcatgtaatcatgttctggtgcaggacagagggacaaaggaaaaatactcaagaacagcagggtggcggcaagggctctgcagataacctgaattcatgtggaaccggtattgacttatctcattctgactgttgtaggttgaaacctgaaacttctctgaaggggtatagtttgacagagttctcagtaaccagaaagacctggttatggaaaggtgattgtagaataagtgaagtagctcaggaatggaaaaccaaacatcgtattttctcactcatatgtgggagctaagctatgaggatgcaaaggcataagaaggatacaatggactttgaggacttgggggaaaagtgaaaggagggcgagggataaaagacaacaaatagagtgcagtgtacactgcttgggtgatgggtgcaccaggttctcataaaactccactaaagaacttgctcatgtaaacaaataccacctataccccagtaacttacggaaaaatacatttttttaaaaaaaaagaaaggtgattgtagacagaggaaacagctggggtaaaaaccctaaggaactgtgttgccatatgtaagaaacagaaagaagaccagtgtgcagaagtaatgggtgagctgaaggccactacagtgaacatggggttggtgatgtgagacggggctagagataagacaaaatctcgtggagttttgcaatcaagagtgaggcatgaggctgtaacttgaggtgcagtggaaggatgcttgggaggaagtgacaggacctcactgatgtttagtaaggtctctctggtgaggcttgcagaaaggctccaaactagggaggccaataagcaacctgaaaagaggtccgtagaaagatgacgatggcttggattaaaataggtgtgacgatgactgggattgggacaggaagaaatggaagaaaattgtcgaatgctttgcagagagagtcaatacgacaagttctgtaagacacaagaaggtggaaaaaggagaggaattatagataactagtgtttgggaaacactgataaagatcaagtgattttctgtattcacatgggtttttatatattttattctttttgtattccaagtcagaggctgttgcaatatgacaatatggtaacgcagtttcctcaaaactaaatattctatgaaaatcctaacagattcttaattatagattcattatacttaagtgaaagctgagacaggtgttccaaactgaaaataagcatgttcggaagagccatcagatcttacataacgttgtcatttatttttcatgataataagagtgtcttttctagccaggaatatcaaggattgcatactggttaaacttggattgcctttgtaaatgttaagtgactttcaattaggatgttcccaggttctgccatatgggctattaacatgctgtataggatgtaattaagctctgtgtggcataactttttgctcattgaagtggagtatatcacacacaaatccatataattgtaaagtcttgccatgcatgaggttgtttctgtttatgttaagatggctatttggttagcaatgtcaggatagatactttattttctcttttaaatagtgcttactatattgtttcctttgagtgagcccatggggatgaaacttcatcagaagtgctcttctgtgacatgcactgtgagttattagtggaccgacttttacagtgtcatatttgtgtaactggcaataatttataggatagtcttttcccaatcaactattcattatcgtatagtgaagaagtacaatgaggtggatggaataaatcctgacaaaactcacaatgaagtcaataaattgggtttatctgactttcaaaaatcatgttttattcgaagaggtttttatagaaagattagttccatatgaatagttcatttcattgatgtaatttgaaattttgtcttgggctttgatctagcagaaaacatttcaggaatatgacagtgccttggggaaacctagatgtcacagaggaattacaagttaaaaaccacgtcgtgaaagaccacacaggttttgcactattaaaatatttgcttaataagatgtgtttatttttccaactatataggtatttgatatctaagtacaggtggtactgaaacagaatgtcttttaaattgttgtctatagttattaattttgtttaattcttttatatagagcctttgactctaaccacatgtggttcaaatgtaacattgcaaggatatgtgtgctttattttagctattgatgaaaaagtcggtatgaaagacaagtttgtccctactctttgggagaatatgtaatacctcaagaacataagtacattaaggttctaaactgtgtgagcacatgtagggtttttcttttacggtttttacatctaaaatagagaagatattgtttctaggctggcttggtggctcatgcctataatgtcaacacttcaaaaggccaagatgggaggatcacttcatatcaggagttcaagaccagcttgggcaacatagcaacactctgtctctataaattatatttaaaaaaatagctaggcacatgcctgtagtttcagctactcaagaggctgaggtgggagaatgggttgaactcaggaggccgatgctgcagtgagctatgatcacaccactacactgcagcctagatgacagagtgagaccctgtctcaaaaaaatattaaaattaaaaataaataaaaatatgttcaatgcttataagtgagtcctcctagggatattcagtacaaactctttctttgaaaataaagaaattatcaaggaccaagtcagagttggttcctcaaaacccatgcccgagctgcagataaacagagaatccagatgtaatactcagcagaacgggactgagaggaaagctgggctgggccagtggttaatctcaacccagagagaggcgctcatatcagccgggacttggaagacagaacatctgaaaatgtggttctagaagagctttcatggtccccctgcctaggagatgtaaaggtgctgctgtaggccgggagcaagggaagcccagaagagcggtctccctaataactcgtgtctcatgatcagttgtcttgggaactctcccagaatttgcatcagaggcaattttcaaacccaaacattcttttagctcatttcaagcccccagttaagacaatctcaacctccttcattaccctgggtggtatttttgggtgacccgtgcctgggctgaccagatgcatcacttcatctttctagcaactgtgtccagctccaccgtgaaggcctccacagggctttcaactcagtcaaagcctcgtcactttgatgtattcattcgcagtgtgagttccctgctgacggccggtttattgttacagaagcatagttgtgtatagcttgggtgttacaaaagatgtctatgtgggcctccatttgaaagacaacacgttggcctttgaaaaaggcaagtgaataaagtgataaagaatacgatcctgctgaaagccaagttaaaacgatgcatttaatcttaagttggaatttatcaaaatgaattcttacctgcatgtctgattttgtcatgataccttggtttctgatcttgccctagtgtacaatgcgtctctatatgtctatttcatatttaaatgggatttaaagcctttcaattccatatcatctggactaagcctgaatatattctacatttccacagttcatgtggccccaatcgcctccttgttgcttcagtggaaattttccttagctagctactatgtctttgagggagctcttgagcctagagagtaaaacttggcctcagtcgcatttggctgttgtcttttatttcctaagaaccaactgtactcttctattaatcccttcccccactcttctaggtaatcaaacaccaccctcagccccacacccctgaacctgcccctgcatcccattgcagagttttcttctcaagggctttttgtttatttgtttatcttggctcactgcaacttccacttcccaggttcaagcgattctactgcctcagcctcccaagtacctgggattacaggtgcctaccaccacccctggctaattttgtatttttactacagacaaggtttcaccatgttggccaagctggtctcgagctcctgacatccagcgatccacctgtcgcggtctcccaaagtgctgagattacaggcgtgagccaccacacccggcctctcaagggctcttgatgggactttggattcacttattttatgactccttcagggaatcagcacgctaaaccctcacctacagcttctgggaaagagaatgagaaatctcccctgtgcttcctttcaaatcattttcctcgaaaatgcctggcctgaagaaataaagcacacatacctagaagccctcatcacagcgaagtctccctaaatatgaaaaagtgctagcatttcctgccacatttcatatttaaaaattttaaaaatatgtgtttattattaaacaacagttaaaaaatcagattaatcattgttgcggtttttatggtgctaattaacagggctgaaatctttacaattctcattttattaaagcctgtgtcaggttttaattgaaaccctgtgtcattttattgaaatccttttttcaatttgctcatccatcagtttagaccttagaactctgctgtccaatatattgtgagccaccaatgtgagccacatctcattttaattctctagtagccaaattaaaaggagtaaaaagatacaggtaaaattaatattaatatacatcattaactcaatatataacaaatgctatttcagcatgtaatcagtagaaaaacattaataaaatatcttaccgtatgtttttcctgtgaagtcacagaaatgcattccgtattttgcccttgcagtgcatgttaattcagactcatcacgctttaagtgtgtcgtggctgcttatggctagtggataatgtatgaggtacggcacttaggggacagaggtgcagaatgaaaagttacacaggattgtaatgtctattcatctttcccattgggagctttgccactctgagctttgggagggaaatcgccgtcatttgacaaactttgcacatagtatctggcaacctctcagtattcctaggctgttgtgcccgtttgttaacatcgaattaagtgaaagagtcagcagttttttttttttggtttttgtttttttggaatttctttctcagataaatcaacaactctgtcaggataaattagtcatcatctccaaagctatagatatttccattggaatgtttgactcggctggtgaatgagatatttcttccgacatagcatgaggagactaatttcactgtgacatttttgttttctacaaatcaccaggatgaagaatgaaatatcagacttttgggcagagggaatattcaggcacagagactggaagcaaaaacattattaggtttcagaactatttgaaaactaaattatttgatctgtttgtataaaattaccagagatgtaaaggtagaattaaaaatgaatatttaatcgttacaatgaaactgaggatcagaaaagtatttaaattaagttaatttaaaaattttttaaattaccatctttatgatcaagtcatttttaacatatttatgttaaactgaccaagactgacaaaagtattttagagaaaaacatataagtttactttgtgttaaaaaggttatttgattcaagcgtaagttaaatggttcaaacatatatccattgcataaaacgtgtaaatgattttgtatttttattgttatacattatttttataaaaatgttatttgattcaagcataagttgaatggttcaaacatgtatccattgcattataattgtaaattttttattttattaagttatactttatttttataacaaaatgttatttgattcaagcataagctaaatggttcaaaaatacattcgttgcataaaaattgcaaacgttttatacttcctttcctaaattttgcataagaaatatcatcccttgccttgaaatctaacagtatttaactttcctttaaataatgcaaccgggattaaaaatgagagtactgggtccctgttacacatgcacccagaagatggtttgcaggaggaagcgattccagacattatctggcaaaactgaattactttgaagttctcagctattttatttatttttgacctaaactaataacccaccaatattgcaaactgtgagttctctgatgtggtaaagataaagaagatatgaagacacaagccacagtttatacctttgggatgagaatcatttgtatgaaagggccatgagatcccaggtaatttattcctcttgaaatctcttccggaaccatagaaatcataaactactgatgccgaattatgttttcagctgactcagccttcgtaaccaaagggaacctgggcaatatactaaaaaagttgattcaacttttcttagcccagggatagaataccaaacagtctttacttagctctgcacagtgagttactctggttctcatttagacacactaaattctaaataccacatgcatagctcattttatgtgcctactaaaaaaaaaataagcccaaagttctgttccacaaatcaactatccatcctctctttattctcaacaaacctgtatttccactttggtgccaaacaaaacccaaaggactttagggtgtcacctgcccaggaggaagtcattgccgtgactgtgaagctgagaagacataaatgaagacggaatgtaataaagcaagtagaggtagcgggtgacagaaggtggtgcccagagaaaaaagttaccaataaacccatgaagtgatagaggcggaagcaaagaattgcctgtcggggaagacattaattaactttgctgtgcatgagtacctagcagctcttgtctatcctgaaattacagttaggaatacctattgttctttgtggcattgttctttttctagatattcaacctaaaaaatgcccaaggtttcagactcttttttactgcttgcttcatagatacagttcaacgacttttaaagtacttgatgtcaagatttcagggatatttaaaacacctgttcttccccctagacacaagctcttacaagggtaaatgtctctttaagggatgcgtccagaggttaagtgatggaagcaggcacatggcagagtgtctagtcaaggaatgaagtgactagcagtgcttaaacgattcaagggttggctcagaaaggagaagttccgtctttgctcttaaagaaaaaaaattgtccagaaaaatcggagacaaaacataggacatttcaggaagagttaacagcataggtcaaaaggcagagatgtcagaccgcatggtgttctgaggaactgtgatgcagaagttgtattacaaccagagcaaagaatgtgaagggaaacatgagagaagggcctggaaatgtaggaaaacctctccatgttgtcttcatcgcatccagcttctggaagcacagttcatggtttttaccttctccgtgtgactttcccatattccttgccatgactaactttgtttctcccattaaactttttgtttgtttgtttgtttgcttgtttgtttttttgagacagagtctcactctgtcacccaggctggagtgcagtggtgcgatttcaactcactgcaacctcccgctcctgggttcaagcagttctcttgcctcagcctcctgagtagttgggattacaggcatgtgccaccatgcccggctaatttttgtattattagtagagacagggtttcactgtgttggccaggctggtctcgtactcttgacctcagtgatccgccctcctcggcctttcaaagtgctgggattacaggcgtgagccaccgcacccagctcctggtagactttaatggagccaaaaatgtcctacacttagtggcattgtagccatataattatgcgtcatagcagaatgcataatccacatgcgcgtgtgtgtggtgatggtgccatatgcaaacctgcgctgccagtcttagacgggtctcatgcatctacttatgtacagtgcataatacttgagaataataatgactgtgttgctggttaatgtatttcctatacttttgattgttattttagtgtgtactcattctacttttaaaaaagttaacctagagctgggtacggtggttcacacctgtaatccccacagtttgggaggccgaggcgggtggatcacctgaggtcaggagttcgagaccagcctggcttacatggtgaaactccatttctactaaaaatacaaaaaagtaaccaggtgtggtggcacacacctgtaatcccagctactggggaggctgaggcgggagaatcgcttgaacccgggatgtggaggttgcagtgaaccgagtttgcaccattgcactccagcttgggcagcaaaagcaaaactccggctcaaaaaattaaaaaaaagatagaacaccctcaggcaggtccttaaggaggtattccgaagaaggcattgtgacctataatcccagcactttgggaggtcgaggtcagcagatcacctgaggtcaggaattggagatcagcctggccaacatggcgaaaccccatcactaaaacaaaacaaaaaatacaacaatttgccaggcacggtggcgcatgcctgtagtcccagctactcaggaggctaaggcaagagaatagctcaaacctgggaggcagagtttgcactgagccgagattacgccactacgctccaacttggacaagagagcaagactccatctcaaaacaaacaaacaacaacaaaaacaaaaacacaacaacgacaaatggaagaaaaaggcattgttaccataggagatgtcagcttcacgtgtgctgttgaccctgacaaacttccagtgggacaaggtatcaagttggaagacagtgatattgattgtcctgaccctgtgtaggcctaagctaatgtatatgactcacttttagtccttctttggtactcagttcaaacaccatatatcccagttcaaacaccatatatctaagaggaattcatcttagactactgtgtcctcttctgagctcacatatcctacacatatttctaccttcccatttgccacatggtctgggaagtgtgtctatatggctgacccctgacctcaacaaacatggtttatatatagcacccagcactttggagagcactttgtgcaaggcattcaaattaaactgaccagggtcaagatcatactgcattcaagcagtgcatctgtccctgaagaaaatgcagaatcactgagcgtcttaagtggaaatgtactcgaatgagatttttctatctgtgaagatgactgtgatgttcaagtggaaagtacgctgaagggattcaagtctggggacagcaattcgggaaacgatgaattattcaagggagaggcgaagctgtggcgtgtcttgtccagtctgcctctattatagcactctggatccctgcttgatttagtttaccccttgcaaaatcactttcaggccaggtgcgatgggtcacgcctgtaatctcagtactttgggaggccaggcaaaaggattgcttacatctctatataatttttaaaaattagctgatcatggtaccacatgtgcctgtggtcccagttccccaggaggctgagattggaggatcacctaagacccccagtaggccaaggccgcagtgagtcatgattgctccactgtactccagcctgggcaacaaagtgagatcctgtctcagcatatatatgttacgcatgttggcgtttatatacatacgtgtgtgtgtgtgtgtgtgtgtgtgtgtagaaatcaccttcgcttttgagctccagcattcttggagaatagaaagagcagtgccaccgacgattgaaggtgaagttggaagcacttctagcttccaactttctttaccttgttgataaaatattaatgtaaacttgactttctggagcaaaacaaagagggtagctataatgataaaatgaaatgacatgaatctcctacctgtcactctctcatctcttcatagcttcctgtgacttattcatgaggtgagaagttccttataactgaaaggtatgaagcagaggtgtttgactacacagcccaaagagggttgtccatagtgttagcctgggagacattgagtttcactgtgggcagactcatcctctgatgtcagattcctttccgcctgctagaccagcaaatctttcccccatctcctcctacacttttctctctactctgccttaagctatgaagctgtgccattttcctacaaacaggaaatgttttaccgtcaatctggatgtcaaaagagagtgataaatcattgatgtcagcttttcccctctcttttgaagtttgtcaactaccaaaccccttagaagaagggtgtgagtgtgagtgagtgtgggcatgtgcggtggtcttgctttcaagtttgcaggaaggaagtgtgagcaaggctgttaaatcatgcaagggatcttgtcattcacagtagttaaacagcgactcaaagggaaagagggacgtaggtcgggtgttttggggttatgccaggtgtgttttaacaccatctgtctatcttgatcaaattcctctggttgtgttttccatctcccttcctttgttgactgccgtttcttcagaaggtcatcattgctgtcatcagacgatgccgggcatcccttgctgtggggacccatgggaccctgtttctcccttttctagcacttctcattcttgcacctccttcacgtcttcatgctggctagtctcctgtcttcttggggtaagcctaccctggtctaatctgcagttgtatctctcatgcctaagaaagcatttagcacatgcattgagctcactggatagctgatccatgaggagttaattagttaataattgtttggtgctgttttctgaaactcagatttccctccaagagtaaacatttggagaccttaggaaggggtttagctctctcacatgagggagtttctttggaacatgtgtatgttcttctctcccactacaccctgtggctctgaatagagagggtgaagcacctgtgctgcacggacccaggggctgcatcttggggtgggctctgcgttttcatggaggagcagctgtggggagtgtgcagttggcatcctatgagtgtcagaggaggcactacccttagctgaaactctctttgggtcctgggctctcagggaataacatggtgccaggctggctgagcccggacctccatgcctgctccaagccgaatagaacgagagtcgtggtttggggttggaaggttttaaaataaagtaaaaatgggctttttcttaaaatacaagtaagtataccaaagataccaaaagaatccacttagctaataccaggtttttgtctggtagttaacagggctgaatctgcatcttagcaagaatgtccttagtgtgaagccgtgaagggtatgctctggactctgggaaagctggacttggtgtggccagatgcacgtgcttattaaacattcctgactttggtctgcattggggcttttggaagacctctgtttctggaagttatttctccttagctctttattctgaaactcagcataccttctgagagtagagaagtggaaagttccattaaagaagagctttaagtttttaacatgggagtgttttcctaaaatgccagatgaatattgcccgtaaatattctgtgactctaaataaagaagatggccaggcgcagtggctcatgcctgcaatccctgcgctttgggaggctgaggtgggtggatcacaaggtcaggagattgagaccatcctcgctaacgaggtgaaaccccgtctctactaaaaacacaaaaatgagctgggaatgttggcgcacgcctatagtcccagctacttgggaggttgaggcagaagaataacttgaacctggtaggaggacgttgcagtgagccaagatcccgccactgtactccagcctgggtgacacagcgagactccatctcaaaaaaaaaaaaaaaaaaaaaaaaaaaaaaaaaaaaaaaaaaaaaagaagaagaagatatgaccactttggatttggagatcctttccagagtggacaattgaccattttcattggggagggggaggggtcgtctctttctactcgaggaacacatgtcccttcatcatgaagagctctctctataagatcttcatttctctttcccagagacctcatctcaacagattatcttccttcaccctgtttctttctctcttgtcatctcctaaaattgttttttctttacaacacaatgagaagcattgttcgaacctgtttaatcatttatttgttggtttatctttctcttgattcgctgcctagaatagtagaatagggaggaccatatagaatttatgaggtgtggaaagtgaaatatatagtgcccccttacccctgagaaatatgttccaaacccctagtagacacctgaaaccacaaatagtaccaaaccctatatacagtataccatattttaaaaaaattattgacacacattaggtatgcatattttcaaggttctggtcataattaaatacattcccatgatttgtaaaggtaaaatcagtgtaattgagatatccatcttaaatatttgtttttcctttatgttagaaacatccaaattattctcttctgtttggtacattattgtgaactgcagtcaccctactaatctattaaatactaggtcttgtttcttccattaacctgtatatttgtacttattaactatacataaacatctatgaggaagtttaatttataaattaggcacagcgagagattcataacagctactaacggaatagaacaatgataactatatacaataataaaagttatgtgaatgtggtctgcttctccatcttgctctcagaatatcttttcctgctgtgctcacttattttctgacagtggttgactgtgggtagctgaaaacacagcaagggaaactgcagagaatgaggaacaactggctagtttaatgtggagaaaatgaatgcaccgtaaccaggatcgaatataacacgtgcccttctgtctgaaaagtcgtgattctcccagatgcagagagcacagagggaaggtttttatccaatcttgttttctttgagactgagcctgcgattgttgtgttaatgagatagagacctaaaggtgaaggcaggtttgtcaggaaggcaagtattgtcatcatcagaaccaacccacggggacctaataacacagacaatatcttactgccatttttaagtttgatgttgtaatgctttcatcaagtaaacctattggaggaataaatgagatttctagtccagtgaattatttgttctttttcctctttctatttactcttgatgataatttagtgtaacaagtctggagcatcactggctctagtttctctgccacatgctgggattcaaaggctagaatttagactttctaggcccgttcactagctcactactatagatcaaatgaacaatgtggttttatgactttccatgttatgtacatgagaatctccaagtccaaagaattcagagtatgaaaaagtcaccatcattgataagagactgggaggatattgtctaggttgtttatttgttaaaaaaaaaaaaaaagaaagtctagcagtgatagacatttttaagtcatattaatttttatgtaatttcaaagcagtattttttcaaaagcacagttttttcttttattttgtttgatatcttgtttaaacatagtcttacacatatttttgagtttaacttttatatttacacagaaacctgagggactggcacaatatctgtcagtgtattatactatcaatataattaatctcaattcattccagatttaatttcatctgtaagttttaacacagttctctaactcctgatgtgttccgaaaatgcatgatttgttcagaagtgaactaatactcaacaccattggttattctttcttctgttatcaatgacacatcctcagacactttacccaaatcatatgggtactctatgttcccataaaaggagagcaaagaaagaaactatgttgacctgggactatagaaacttaacagcttctcaccctatatctgggagaaatactaagcaaaatatcccatgtctaattattttctgaaaaaatgtacagctcaaatatcaggggacatttaatctttttcccaaacatcttcatgtgcctcttctaccattgcttagtttagtctctatgtaactattgtaatttagtaattattatgcagatgattgtctttcaaagatcatttttttgggatggctgacttcagaagtaatgagagtgtcggtttttaaagtcatttattttcaccatgactttaaataattaacacaagtgggtgtgtctagtatgaaggagtccgcttcttcatggtactggagttggcttgaaataatcacaccgtgacgaataaatagaaaatcgtggcagaatagtccattggaaatgcaagttgtggattcatacctaagttaagatttctacttcagaatcagcgatcaccagagggctaagctaatgtctccatctcagcactattcacatttgaggttggatagctctttgtttgggaggccgttctgtgtgctgtgggatgtccagcagcacccatggccttaccactaggtgcaagtggtatccaccctgatatcacaaccacaggcgtctccaggtagtgccaaatggcgtcacggaagggaggatgaattcggccacagttgaaagctatggagtgtgcaaatcattatttcatgacaattctgtcatgctctagagatgacaggtgtttgtttttaagtttactccctgatatagtataatgtataagaggtaaagccatctagagtcaaagatgtccttggtcagataactggctctggtttgcaggaactgagtagaaagaacaaatgactcaagattcagatacagaatttcagaactaagtataagcaagatcgcatttctattcagaatgcagacgagctgatgagctgggaaacatgttgaaagtgtcttgcagtttgcatcttgacttccacgctgggggtaccagaatctggggctgagctggtacgttattgcaaagaacatgggttctgatctcaagctcttccttcagggaatttgaaacacattttgcagaataataagcatcagctttattttaaagacagtttttaatctgttgcattaatctgttgaacggttctccttttacttaggtaagaatcacatatttcagggtcttacatttctcagaaaagactccagaagcaacagacttaacaagtaagaagagtagcaaaaaggaaaagcgatcactttctcttctttttctcttgtctgatagaaaacataaacttcgaagctttcaagaagacatactttaagtttttcagtaacagaagacattaatagagtgagatcattttctgttgcttcttgatccctcatacctccagaaatggaccatggaccatttggtataggaggagtgaatagttgaatattggaaagtacagggcttttaagccacttaaataattttgtataattaacataatatgttcattattgcataaaggcagtttgaagaatttctttttaaaatatcttaaaattcttgttaaattgtgttatagactcctacgttgtgttatattagagtagatggatcagtcttcatattcacgccagcccttcttttaatgcacataaaagtccaaaagatacgacattactaaataccatgcttatagacttaattaaaatagttcttttacaggcccctagggaaaatatcacctccttaaatctcctagactgtttatttacttcacatcattgcaaaatcaaatttacttgcagtataacagatcatatgatatcttagcagatattaaaggttatacaattaaatgtatttgcatggatagcaatttgattgctatcttaatgatgacaggacaatttcaccctcttttttattagcaaggatacctgactgaagtaaaattatgtcatgaatttctttgaaatgtaattgtgttacaatgccagtgggaacatatgtgaaagtcttcatctagttaaaaaaaaaaaaaaaaaaactagcttaaaatagaattttcttggtataccagcctttatacaacactcaatttttaaatgctgtcacaatataccattaagtaatctaagagttaattccagatttcctcccaagaaattgcactgcctgttccctttaccatgatagatacctgacgttatcaaagaggacaaaacacattatcacagccacgaaagagctggcatgtcattaaactggtcctcgttggccaattcaggatgtgatgaaataaatgtttcaaaactcctagcaacctcaaaggaaagacagttaattcaatagctactatacattgacccttggttaattaaaataggcaagacttggggagatgtggtgtttgtggagtctactgaggaaacaaacagctcatgttgtcatttgcatgcgttgcaatctcttccttaattcctctttactgtggctaggatacagatttgtcagtcaatgtattttccattttggccctttatagcgtaagtatttatttcctcataagcaaggtctccgaggatagttgaatttcagcttagcttttgaactcttccccacaaactgtttttcagtgttgtgaaaagaacatggaccatttcaaggggatcgtgtcttattttaatctagccacatcattgtgagcactttaattaatatctaggtgtcaacagtccttaatttccctgcatttaagtatctcactacctggtatagaggctgaggacaaattgtcattcacatgactcattgagaggcaaagctcagaaaaggaccctgtgagattagagtccccaccaaaaacaatgcattattattttatttattttgtgaagttccctttcctgtatcttttgagtacaaacgatatattgtttgtatgtggtctcttttattaaacaactcactgcttagacttacagaattgtcatgtgaatatgaatacaaatatggacacccgtttaaggaaattattgtgtagctttttattcattaccccagtgactgatgaaatcgtgaaatgctttatggaattttttttttctcactaagcataagaagattagtaaatggtttgaattaggttgtaagcatctcagaaaaacactgaagcaaacaaaaacaaacaaaagcctttccaggacttttatctatatgtgctttgttaagactttgtaggcttcaaatgagcaaaaacacaacacatagtggcttaagtaagacaaaaatgtgttggctaatggagatgaacacccttaaagttgctgaagcagtgtagacatagcactgattctcctcatctctcactcagctattgtccatggaggttccctttctccgccgcattgtgaaatccgctttcacaattttcctacaaaaacaaacatccatctagtattgaatattgattcctggcatagatggtggcaaggaatggcctgacttgagcctggtcctgggttctgaaggagtgtgtgcctgtggttgtcccatgatggccttgaccgaggatgtggtcaggcgtgcagagaaaagaacacattgtcaaggaacaccagggaacaactctgctaaaactctcaacaggcactcggttgggaaaaaccaaatgtctattctagataaaatccatgcccactcccagtaagtcgaacatgaagcaaatgccttactacatggtctatagatcagaacaagtaagaatcacaggtaaaggctgaagtttaaaaccataattgtccataattaaggtacagtgtgaaggttatagcaggttagcagttttccgtgctcataaacttatctctggtaattgctctctaagtttcataattaacttgggtgtttcatactcacagattgcccttctcccttaaaaaataattcgaatagaaaaagaattcagatctcacagtcctgttggatatttaatatcatagaggagttatggacataggtacacacagaggagtcaccttagaactacctttatcacgatctcaggaaaaacagctctttagaattcaagattcatcccctgccagtaagacggagtgatcaaacggatggaacagtgttaattcatagctttaaagtacttgtacttatattaataaagaacaaacgttattatccccatttcaaagataaagggctgaatgaggaagcacttttctcaacatctcagggtgaaaatgcctgcgtttaaagctgaacaggagcctaaagatcaatggccccatctttgaattttgtgttacaaagagtgaggtcagcctgatgatgtgccggacccagtgatgcaacaccatgatcattgccaaagccaggaattgaaccaaggctttttcataacaaattcaatgttttacaagagataaaccatttccttctattctatcccagaaaagctactttctcaaagttttataaactaaagactccagtcccccaataatgagtcaccagtgacaagggagaactgtcggagaagcctccttctaacccttgtagactgaccctcggttgattacagaccacaccaaggaggcatcccattctgacctcttccatgaccagccccaggtcccaaaggctgcctcagagtctgcagtgtgcccaggtcctcccgtgctcccttcgatcccttcttaacaagaaaacacttggacttagctctccctgaagggtcaccatatttcccaaatcccattttgatttttgtgactgagaagcactatttctttcccagtggctctggttgtttgggttttgtcttgtcttcgtcctgtgaaacatcaggaatacatggaagtaccagcattccttttgaaatctctatgaaaacttctctatactgtcaaagactagactgtcctgactcattggacatgtatggagcacctgctatatgcctggcactatgatagtcagttggggcctgggagcactcttggcaaaccaaggcagaaagacagctgaataaacatttaaatgtgacaagcatgataataaaaatatgtaggtgtgacagaggactacagacatggcagcaattaattttgcatgtggcagtcagagctggtgtctattttggcctgcagcaaagaagttggaaggcccttgagtaagtaaatgttggttgtatatgaagtaaatgaggattagattaaagatgggagaaaggcaaaggtacgtaacgggtgatattgacgttctcaccagtttttctagaggtctgcattcttgcgttttcagtatgtgaacagtgcattttctcctaatgacatagaaccccccattctaatactttcctgttgtctcaactcccctcttaggaaaaccttccttgaagacctatagattcgtggcagtgtctctggaagtgtggttcccagattagcagcatcagcatcacctgatgttagaatgagaattcttagccgccaccagagacagactgaattagacactctgcaggtggggccaactatctacactttcacaagctctcccagtgaatccgatgcatggcaatgtttgagaacccactaatttctgggatgacccaattaaaaggaaactgaaggatcacgcagcccagtatgaactatccccaggaaccaggtagtttgtactaatcacttttgatggagaaggaaacaaaggtttacagtccctaattctctgaaacagagcctagtgagtagaacagtgataaacaagtgcgtaaacaaatatttatcgataaaaatcgtgaacaagaactttcaatgaaaggtgcattgtgttgtgatatggcaaagggagctgacctgacccagctggtcagaagtctttttagatgaagtgaaacttaactggagacctgatgggtgagaagttatattagtaaaggacagtaagaatgaggtctgtgggggctggaaggggaaagaggaagatattcccaatagagggcagagcatgtgcccggtggcaggttgtcatatatgatagaagctgcgtgattccccaggggctgttggaaagctaagtgtatctcttcatgccttccagcatccttgaatcatccatgtcatgttgactcaaacctgtttaaccagtgccttggctcttcttgcaaacgacccctctacatagcactaacacggaattgaggcttgcctgactagaagtttaaaatccctgatatgacttcagaattctcattgagacctaagggctgcgctttcctttggaaataaatagccttgctctactgccaaatgccccttgaaattttccaattccgagacaaactacctaaagctaactcgtgttcttgcaaggctatgctaggaaagagagagagttgaaagtttacgcaagtgggaacttctagagtgccaaacctcagaaatatcctacaaacaagacctaagtcccttgggctcaggaactatctctgatgcaatagtatttgataatagtgacagcagtgtgcaattattttcaaacatgaggattctccccatatcataaagagagacagactttgcatgtaaattcaccacggtagcatgctcttagtctttcttcataaggcagaaaacatattactgaaaagtataaagagagaaacacagcttttgaagactcattccaatgagttttggttgagtagtaaaacttactttttaccacggttgtcattatcacagtcagtcctttgaatataccaagacccaaacatttccagaaatttgtctttagagaagagaggctcccattaatataaaaagaacaacaatgaaaaaaatctttatattccttagtaaatgtgactacttagtgaattttgtagtatatctcttagtatattttagatcacagatgtttttgcaaaaacaattttaataggttacatttttttaatttcatagagattatagatgatttcacagagatgcattcctgagtgacgtggctgagggtgaacaggtcttctataatcaaaccattttcttcagccactgctgtaacttctgtagaaaaggcaatttaaaaatagagctcaagaatgagacgactttaaagcatttaaatgacacaggaatagggctgcatgtcttgtttgacaagttatgcaagccacctagcctcaaaaattacaatttattttttctatgtgattacttggcaagaaggggattgcttttgtacttagcattaccccaagggagcacagtcattccatttgtaaatgtgctaggatctcagtgagggtctgtgcatctgcctgaatgacaatctagatatctcagagagagaactaaaaatagatgactaaagatgattcctgtgtaataaagacattaggatcccttatagctcaaggaagaaaagccaaaacttaattatatagagatgtgtaggtgaatgaaaacttcccagtgtttactgaaaacacaactgaaacacaattatgttatttaaacacaaagaaattgtggctttgtaagtctgttattaaaatgtgcaattaactaattaacatatcattagtatctgttgaagctctgccctggtaatgctgcattcatgtttcaaagataacttgacatttctggctcagtgatctttgcctttcattacacatataaaaaaaatcagagaaaacatcctctgctgaatacagtattgaatttctataaagggcttgggaatattcccagattaatcactttctattacttttctctttgtcaagtacaaaaccagatactgtattttattttgctggcatgcggtataggttgcttaagtttctgttgatcaaagaatggaaattactatggcattaaatataggtttatcaatgtcctggcttcttcatgaaaatttccattttagaaggtcacaagagaaaattaaaggctgtggatcaaggttaaacttttctttaggaaatgtgccctattaaagtcaatttaaccttcccccagtgcgtgggggaagccatggatagtaataattaagctaccagacttgtgagtcagactgcctgggttacaatatttctagccctctagccagttttatctggcacctagtagctagaataaatcatcagattaagcagttggattaaatcctatctgacaattagaataagtacctcactactactggattaaattatattaagtctctaactactgttaattggttactagattacattgtgtctgctagctagaccaaatggttagaaaaggtagttctgaactatgctgcacctagtatttagtagctaaaacaactaacattttgcattacttgtcttcattgttaaatttgtttttccatacctaaaatggaaatattacctctcattagattgttttgaagatttgataagattattcaagtgctcaacgcattgtctgatgcacatatgaagctgacttacattgattattgatgttgttcctactactctgggaagaagctctgcaggagtttacatttctatgataagtgtgcgtgtaggtagtgagtgaatatgcctcaaagcacagagcaccgtggctctgtgttggttcttttggagactcagttatagaagctgatagcttcaaattgccttcattattcaggccatggccgtatcaggatgcttgagggcttcacacacgcttttgtgtcccacaggcttcaggggcatattggttattattttcatttctatatacttggttgtaaagaatctattaattacccaaagaattaaggccatcattacgatagacagaatgaaaactaggccttccatcctactgtgaaaacaacctgcatgtactccataatctgagaggaagaaaaatccaaagcactctgcgtttgaatggacgacccaaggtatcttatatgatgggttgtgtcaggcagaactgtgctgttttgatgctttcataaatactacaactaaaaggcatattggagaccactaaaccaacaatttttgtccaattataaattaaaatccattgaagaagttaatgtgcaatgaagctgctccaggtctcccccagtttgcctgagcaaaagtcttgcctagaatctgaagacggaagaagaaggagcctttcaagagcaggtgtgtcagtgctttctggtgagcatgtccactacaagaagtgtttggtttgccccagaatagaaatctgggaaactgaggcatgaaatttttgtcataaaggaagttgaaaaggcttgaatggtaattctgcacagagtgaatgagatgactcacaaagactggggtaggggacggactcaaagagtatcacaaacaagtaagattctcgaattaaaaaaagaagaaagataggaaagaatgaaacacaatggtacagtagtacaatcaaatacccaacttgccttcattttactccccaccaaggtaatatcctttctacaggtataactcttagctggaaaactgattcagaaaggtttcacctgtttcttgcaaacaaacaaaaaatcttttccactgcagatgaaagtgttccaggactcagagtcatccctgaacatggtcaggaatcagagtggaggtcagaaagagggagggagtagatcatttctgctccactcagagctgctgagaggtgaccacttctttccttgtgattacagggttttaggggtaacttgtggctcctctctttgtaattctggtatcctggaaaaagttgtagcttcttgcctttgaggctggtgtcctggtggaatctgtggctccttcctctgcgatgctgatgccctaggagaaatggtggttggttcccttgtgatgctggtgtcccgcaggaaactgactccttcccttgtcatgttgtagtcctggggaatattgtggtctctttgaatgggatgctgctgtcctagtggaatctgaggcaattctagaccccttcccattcataacagtggggttcccgtagtatctgttattctaattctctgtgcctaagtggtgttatattccagtgtgaatatgaccaaccaggcctcttcaagaccagaagaagtgaactgtgaaagtggaacgaacaattgcttctctggccacagaggtggagaagtcattcattactgtgctactaacctgaaactctaaagtagtcatttttcactaatccatgctacttttttataatcatgtaacaggaaagaaaacctaccctttctttatgatgtgttgtactcaattattagatatgaataattagattaccaaacatattttctttctcagctactgtaaaattaaaggctaatttcatgatcagttgaagcaaatatcatacacaaatatatgtgtttacatttttcttcctactcacatttctcttaatttttctttcacttctattttgaattatgtgtgcattttatcgtaaagtgattttttaaatgaaaaagatactacaaaatatgcataaaagaaaaaattggacctgtgactgcattttgctaatctcatttatagcaacatgatgcgtaaatgttttatagctattaaaattaataaagtgatcaaatccattattccatagtccattatagtaagtcatgtcaatttagaaaaatagtatttttcattttctggaacaaaatttaattaatgtattttttatttgtgtccggttaattcacactgggtatttttgatactgcttcttttaagacgcattagagtttcaactggtctcagcacaaaaaaaattatttattttagtattctgcacctgcaagttaaatgttttgaattgacgtttaaaattttgtctctaggcttggtgtagtggctcacacttgtaatcccaacacttctggaggctgaggtgggcagatcacctggggtcgggagttcgagaccagcctggccaacatggtgaaaccctgtctctactaaaaatataacaaaaaaaatagctggatgtggtggtgcacgtctgtaatcgcagctactcagaggctgaggaagaagaatcgcttgaactcaggaggtggaggttgcagtgagccgagatcacgccattgcactccagcctgggcgacagagcaagactccacctcaaaaaaagaaaaaaagagaaactttgtctcttaaccttctctccttgtctgctattgtcactcaagtcaaattcctctcctcagtagcttcacacctctttgccatgtttattaaggtgtctacagtggtccattctccacatagtaggcagaaagatattttccaaatgttactcaaattacttcaggaccctaatcaagattcgtcactggcttccaatctgaagttgaataaaatccaaactcctaattctgaccaacaaatctctgcgtggtgccactctggcctctatgaaccctcctctccttccaggctcaaatgttctgagtccactgcagacacactggtctttgttctccttcatgaaccatctgagcctttcccacctgtgggctcctgcgtacctctgtcctgggcccagcccctgggttttctgtgcatgggctcttcttgttattcagcctctgaagcagtaataacttggggtttaatattttctcctttgagtaatctccttgaccacaagctctacctacactacctgtttcctctccagcgtgggttcagtgatcagcttaccattcaagtcttgtcttgtcttgtctattgaagtatttgtgtatagcagtatctccctacccagctgctgctaaaccgtcaactttatgcaatgagaacccgtgttcctgactttatgccaagcagtcagaatgggggttggcacacaagtcatcactcaaaaattatttctgaacaaatgaatgattttatattgctttcagcatgattagaacatgagtacttagaatgaagtccttcaaagagacagcatgatggagagaacactgcattttgatagagatagaccaaaaggctgttgccaccactttattcatcttccgcatttttttctggatttcattgttcttatcattacaaaaggaaataataaatatttcaccctacaacatgatcatgaacatttttggctgattattttcaagtctttcttttgtaggttctttcaaaattcctgttttcctttgtcaaatcaaactattctttttaaagaccacatcatctaagggccagtgcggatgcttaaaagtgcccttcacttgatggagaaacgaatcgaacatttctttagttaaagcaaagggagctaagctttaaattttcaagcatttgcatcacgcttttgggatgtcttttaattaaaataaattaaaattgtcaagcactatattttattgcgttttgaagtgtcatgagtagagaagtaaagtgacaagctcatgattgctttattactaaaggcttaaaattatataaacagttggtgaattacatcctgcaataagcctgtatttctccccttaactaagtaggtggcaaaattattctgctaaatgtatttcccactgagcttagaaagtgacctcacatcaatttcacatgaatgaagttgatacttatgtatcaggctgacaaatttaataagaaaaaaatgtctaaagaataatagtgtttgtttgaaaatgatgcaacattgtccctttcaattaaatatctctataagcacatgcacacatatacagatgtataacataataggaattactataataaatggcaatagtattttaaagtggaaaaatagcagaaatctcatccatgtagatgttccaaactcattttatgcctctatcatgtatatttttaagaatttacaaggtgtgataagcccttctttaatgtctttctttattgtcatagtaattattttttgaatgctgcagtatctgaggatatttttattttacctttttaaaacaatgttattaagataaaatttacatatccttaagtttatccacataaagtgtgcaattccatgaatttttgtatgcttacatcatcgtgcagtcatcacaatccgattttagaatattttcatcacccctaaaaaatgttctgtacctattatcagtcattttctgttctaccctgactccccaccctataccctaggcattgggtattatatgagatctcataatatgtggtgttttgtgatttttcattgacttactttaatgattctggtccctcagtattccaacataccttagtactttgttgatttttaatgacccgtaaaatgctactgaatgtgtatgctatattagtttgtccagagtcatcagttggtgaatgcttgaattgtttccatattttggatattatgaatgatgctgccatgaatatttgcccactagtttttgtgttactatatgttttcagttttcttgggtagaaaaactaggagtggaattctttactcacagggtaacagtaattttaaccatttgaggaattgcaaaactgtcttccagcatatctctaacattttactttccgacaagcaacacgagagggttccaattctctacatccttgccagtgcctattatcatctgtccagtgatagcccttctagtgggtatgaaatggtatctcattgtggcttttctcactgtggttttaaatttaatttcttaaatgactaatgatctttagcatcttttcatgggcttattggccatttgtatgtcttctttggagaaatgtctatttaaatctttttcccaatttttaattgttagggtttttgtggttgttgttgacttgtaagttctctctatatattctggttattagaccgttttggatgtagtatttgcaaatattttctctcattatgtggactatcttttcttggtggtatcctttgcagcagaaaaatttttaatgtcggtaaaatttaacctttccgtcttctttaattccttgtgctttttgtatcatatcaagggaagcatggcctcaaccacggttataaagatttactcttttgcttttttcaaatatttttatgattttagctatgaaatttaaattgtcttagtctgttttgtgttgtgataaaaggaatatttggggctggataaattataaagaaagaggtttatttcactcatggttgttgggggccatagcagaagcatggcaccagtctctggtgagggcttttgtgctgtgtcaaaacatgatgaagaaggtcaaaggggaagtgggcacgtacaaaatacagccaaacatgaggagggaatttgcttaaaaacaaactacctcaacaaaactaatcttttccttcaagaactgttcttaccttgtcagaacaagaactcactcactcccacgagaatatcaccaagccgttcatgagggttctgtctgcataacccaaatacctcttctaggcccaacactgacacattggagatcaagtttcaacattggttttggtggagacaaccatatccaagccattgcatacctctatgatctcctttgagataatttttctgtatggtgtgaggtagggatccaaatgcatttttgcatgtggatatccagttgtcccagcactttttgtagaatttatactatttctcaagcacttcacaggtgtcaataattgcattaaattcattgtgtaagctcatttgtttctcaaaacacttccggaacaataatattttgacatattataaaattaaggtatgtgatttgcccagtataacttctcatggcattaaacttcttgtattcccaatatataatgttattccaataaaggatgactgtatcatcatcaataagtttgttgaaagttctgctctctgctgaattttcatgtctagccactgatttttgttctttttccacatggaaacaactcatacacaatataaatagcgccatatacttcagtggatcttagcacaaagcctgtagcatcaactgcaaatgtttttctccatatttcagtgacaaaagaattgaggttcaaaagtcaagtgattttacaaggttacacaaatagtggacttcagagtgaaatgcttataccccagacattttcattattccattattgataaggatatttgagaaacaggaaagttgcattaatttttcaattatatagcaagtcagcaatgtagcttaaattcaggactgtgatcttccaaaacctagcctcatgtccatttagattagagatttgtaatattcactatagaatttcatagatatgaaaattggatttagcagtgagtaaagttttgtacagcttattataaaacaatgcacagaatgtcaaacgttcagctggcagacttaactgtcagataaggaagcaaaatttgcctcaaatacataacttgttttctgcaatgctacaagtacaagccaaatggggtctttctttactgtaccaatgaaaagttgatgtattcagtttcaaatgataaggttttattagtcacatattttagatcatccattttacctaatgttacatgtatgctttacttcttcaaatccatgtctcacttataggtgggaactgaacagtgagaacacttggacacaagaaggggaacatcacacactaaggcctgtcgtggggtggggggaggggggagggatagcattaggagatatacctaatgcaattgacgagttaatgggtgcagcacaccagcatggcacatgtgtacatatgtaacaaacctgcacattgtgcacatgtaccctagaacttaaagtataaaaaaaaatgctgtgatcaaagaaaaaaaactgtagaatcagttgtgaaaggtaagttatgtgctattcctctttttcttatgatagtcaaataaatacattataaaactttttattgaagtgttaaataaaactattaaactatgtagcaaattgaggataataaaaaatggcatttggaagtttttcatgttctaattatttaagcatactatacaaagattgttaactttttcagatctgaaaaagtattatattacatttatatggcatatttattattcacccatatatataaatggatctactaaagagtttttatatatatgatatgtttagcttgactccacatttcttcttttgcacctataaacttgactatgtctgtatgaacaaaggaaaataggaaagagtaggaaaatacaacattttactaaatttcaaccaacacgaatttataaacagatgtcccataattaaatacaaacatagtaaaaaaaatttctaaatactgatctatagtgacatttttgtatatgtatacatacagttatgtttgtacatgtgtatatacacttatatgtgtgtaaatgcatcttcttgaataaatgtatgtattttttatatagcatgagtactggcttcatggaagcaaagttaatattttatttataattgccttttcattgcaatcacctctcaaaactctggaaaagtgttttcatatgatctttgctgtctttcctcttctttctcaccttttgaccttctgcagtatatccacaagatatgaatcaagtggttcctgaaatcaaaatgagtatatcagtgaaactgcactcttacctcacactcacacttgggcatataagagacccaattaaaaaactagaggctaatgtaagagagtgacttactgccatcagatatactgagttgtcttaagatagacgaagcactaatcctaagaggaaataacattgataaataagatattattaaaaagtaccattatgaaaataaaaaggaaagctacagctcatttcatacagaaatgaactctgtagcggaaaatgttaaaaattgttttatctaataaaagactacatatgatgcactaaacatatttatatactgaattcctctaaataaataataaaaaacccactaagacttcaatcatcacaatacttcaatggattattaagaagaaataaaaatggtcaaaaaagcacctgaaaagtttatcaacatcaataatcttcaaggaaatgcacgttgaaaccgcaatgagatgccagtaaatagttatgagaacagctaaaattacaaaacttgacaatatcaaatgttgacagggatgcgtaacaacttgcatgctcacttactgtgggaatataaaatggtacaatcaccttagaacaatcgttagtgcttttatatgaagtcagacatatacctacctaataacctaggaattttctgttttatcacgtttaatgaaaatacgtgtccacaaaatattttgtataagaatatgtatagcagctttgtttgtattagccaaaaggtgaaacaatccaaaagtccattaattggagagataaattataacatatttgtataaaagaacactacccaacaataaaaagtgtgacttgctgaaacataaaacatttgtgaatcttgaaaatattatattgtgagacagaatccaaatttaagagagcttgcctaatatataattccatttatataaagttaaagatcagatgtaatgaatttatggtaataaaaccagaaaagttgcctgtggagggaagggatggaaactgaatgtaagaggaaaaatgaaatttccatattgatgaaaatgttttatgcctgcatccggggtgtgggctctacttgtgacagtgaacagtttgtcaacaatcattgaattatataacaaagacatgtgcgtttcctggaagtatattttacctcaattttaaaaactactttatagccacttgagtttgaaaatagagatggttgaagttctttgatatttcagattgaagttctttgacatttcaagttgaatagactttgaaattcaattattatgttgactgtattttattagtatacttcattatttacttatgttttaaatgttcacccattaaaggagaagtccatcttaataagtgatacattgccctaccacgtatgtgctgatatatttttaaatttatataattaacaacattattaaatattacattaactttttagctgtggggaattatttaattatacttcatcttcattacatattaaccaaaatcttcattaggctataatgagttgttaggcagaaccgtgaggaatttccatttttgtagaaacaatagaatgaaatgttgacaattgcctagctttaagcttatctcttatgttgataccatgaaaatgaagtgaatggaatttcaagaatatgatgatcagaatattttgtataattgcaaccacctataacaaggtgacatatagaattgtttcctacccattctcatcttttctaaccttccaatgtatacatatagatatataggtggatatatatctatatctatacattagaagatatatatctatacatctatacattatagatatatatctatatattatatcttagatatagatatatatctatcatgtatggatatagatatatatcttagatatagatatatagatatatatatctatatctatacatgatagatagatatctatatacatgatagatatctatatctatacacgatagatatatatatctatacatgatagatatatatctatatctatacatgatagatatatatatacatgatagatatctatatctatacatgatagatatatatctatatctatacatgatagatatctatatctatacatgatagatatatctatacatgatagatatatatctatatctatacatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatacatgatatatatctatatacatgatagatatatatctatatctgtacatgatagatatctatatctgtacatgatagatatctatatctgtacatgatagatatctatatctgtacatgatatatatatctgtacatgatagatatatatctatatctgtacatgatagatatatatctatatctgtacatgatagatatatatctatatctgtacatgataggtatatatctatatctgtacatgataggtatctatagctgtacatgataggtatctatagctgtacatgatagatatctatagctgtacttgatagatatatatctatatctatacatgatagatatatatctatatctatgatagatatatatctatatctatacatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatatatctatatctatgatagatatctatatctatacatgatatatatctatatacatgatagatatatatctatatctacatgatagatatctatatctgtacatgatagatatatatatctgtacatgatatatatatctgtacatgatagatatatatctatatgtgtacatgatagatatatatctatatctgtacatgataggtatctatatctgtacatgataggtatctatagctgtacatgataggtatctatagctgtacatgatagatatctatagctgtacatgatagatatctatagctgtacatgatagatatatatctatagctgtacatgatagatatatatctatagctatacatgatagatatgtatctatagctatatatgatagatatgtatttatagctatacatgatagatagatatatatctatagctatacatgatagatatatatctatagctatacattagaaggttagaaaagatgaaaatgggtaggaaaccattacagacagtaagagagagagagagatcattggtaaattgatcccggatatgggcttccttgataattttaccttcagaattaaagtttattgacaagttggttgtcactttagagatgtgttattttgtttcagagtacagtcttgacctggaagttgcaactgtgagatatcggaggagttttgctaggtttacagtcaagcagtgagattttttccagtaggataaataccaaataatcacataacttctagtcatgtgtttagcaaattaaaaaataattattaatatatcgagaaaaaaatggaaaaataaaccaatgggttactagcactttgatggcaggaaagttgtattaaatacttattttagtattataacacacaatacaatgtaatgcagagagtagctatgaaaaactatttgttgatttaattggtttataagtactgattctatgatcactacatttaacaaaggtacaggttgttagtgatagaaaactacatggatgaaacttcatgatctataagtgttttatttagcaaacatatgtttactcagcttaaaaatcaccaggcgcagagttttcagtttgaagtcgctacacctaggaatactaagggaagtagctgcaggccatcaacatctcaactgcgtagaacaggattgtcccaagaaggaaacccctccccttaaaccagtgcttctcaagctttgagtaacataaagtcatttgctgggataatgggaaaacacaaacaccggttcattaggcagggtgtgtgcctgcgaccctgcatttttcatgagccatcaggggaagccaatgatggtggaacacggttcgtcatttgagtagcaagtctttcgtctgtctacgcgtgggataagcaggggttcaggaagaggaaagcagaagaaccatttattacacatagcagcatttacccagctctgggggagagtatcaagagaatcacagcaattccaaagggaactctgcgatttgacaaatggtccatcagcgacactcagtcaatatttattgagtgattcttgtatgcagatcctgacatttagtgccctggggcataaaaggaggtagaaggcaaggtctctgtcgtcaagttcctaccagttccagagagatcctacgaaaataaaaagtgcacaagaccacaaataaacatattaacttaccctgaataatgaatcatgagtggtttacaaatgctgagagatcatccaagcaattgaggtgaggcttctgggggacatttgggaaggtttactgcaagagaggcatgtattagggtacagggtggcaggctttggaggagggggtgtcatgtggaagcccagagatcgaatccagagatccacctagagaggggggcacaagagggctggcttggctggatggggggcatggcaggagttactagaaaggggagttcttgcagagacagtggcaacattcttgaaagtaggcaaggaaaaatatgggttggtttctgaacagaaaaagaaaatgacagaatttaaatgatagtcatggacattctagctgcataaacagatgggaatggaaattctaaaaataggaaaattgcctgagagactgctgcagtcgcttgagattgatgaccattaaggtctggaacaggacttagaccatagcggttgagagaaaaattgctaaacagaaaaatgccaaaatccatcagcccctctgcaaagtggtaaattattcgagcagttccttccactcttgtgggtatcctcctcgagacacttttggaagtgttaattgcccctttctactcttttgggtgttttactccattcttagcactcgcccatcctcagagtttaagcagagtgaggaaattcacacctgtggtagagtggatggttctagacggtgatccttcacagtggcagttgtgcatctgaaaataccaaaggaaaaagaccctaacggtaaatctcaggtaggttagatgttctcaaggcaagtatgtagggtgacttaaaatttcatcctgtgcttcaagtcaaatacagagagtagttgtttctctgtcattatcaatatatgccttaaattgtgagagagagcatgaaaaggcagttctcaacatcagaaaatgagcattctggttgaaactctttcaccaacttgactgtgtcaattttagaaaagatttcatgattgcggtctctgttttgttttctgtaacatggcaaatgattaacttactgcctgtcatgatttgtctgagggtgaaaggaagaggaaggtatgtgggagctaacaaaggaggagtcaattccaaagttactagtctgaaaaataaatcaattgtgagataattgacagtaatcagcgagttgcaaaaacgctttggcatttaaggcaaaaagtaagctctccgtcctcatcttgttcagttttgcctttgtttttataaccaaatatatatgtcatggttaagaaatgaggcaggaagtggctacattaatgatcataatgtacatgtgggtgttcattgattttattattattatctcccaggaagtttttttcttcttctttttgagaccaggtctctctctgtcacccaggctggcatgtagtggcactatcataactccctgcagcctcgccctcctgggcttgagcgatctcccatctcagcctcccctgtagctgggactacacgtgtgcaccatgacacctggctaattgttcaacttttcgtagagacagggtctccctatttggcccaggctcaggaagtcattcttgaaggaggaaaacatagagatttggttaaactttgaggttgcccaagttaattgactgtcaaaacattagaagtaaacaaaagaattagaaatcagaaaagaacaaggaagtgatgtgtctgaaggataataagctattaggttggtgcaaacgctattgaggtttttgccattactttcaatgccaaaaactgcaattacttttgcaccaacctatacaaagggtttgatacattatttttttattattattattatttgatactgagtcttattctgtcacccaggctggagtgcagtgctgcgacgtcggctcactgcaacttccacctcccaggctcaagcgattctcttgcttcagcctcctgagttgctgggattacaggtacccaccatcgtgcccagctaatttttgtgcttttctagagatgggtttttgccatgctgaccaggctggtcttgaactcctgacttcatgtgatcaaccctcctaggcctcccaaagtgctgggattataggcgtgagccaccatgcccggcctgttaaggtaattttaaaattgtccatacccttgttgtagagatgacttttcaaattattcaactaaagaacgtattacaagctacgtatcagcactatgctaggatgctgtgagaaatacagaggaattttaagaatcccctgtcaaagagctttgaaagattttcttcaccaaatttattttttcacattgtttcaggttatcctatgaaattctactatacttaaattcagatacctaaatttatgttcattaattagagcaagtttatcatacatgctttggatataattatagaatctctaaaagcattttggtggtggaagtttatgtttggggtaggggtttacaaacacatctaaatgctcctaaaatataagtaataacctagaagaatatgtttgtcatgcactccagctttaaaagttataaagtgttccatcacactgattttatgaaattaatttctcaccaagtagccataaatcatattaaaaatgatcatggttttagtggagtctttataacctgaaggtgttgcattccatttgcctataattgaagaatatttttgaccatctttcctgtgagttaaaatgacaggtgtcatctgttgctcttaggacctgacagttttgacacatccattcattagcgacagtttccatctcaaaaagtagctgcctgggagagggacggttactcagggctctgacatctccaggtcccattatcgacctcaatgttgcaaaaaccccaaactcactatactcagcagttatttctgaaggtcgttatctttgaaatggagaagtttgggtgtttttgtcaaaggtatctagatatcaaaaagataaaacaaaccctgttaacaacaacaacaaaatcccagctattatctctttgtgttttgataagttgttattgtgaaatgtaattgttgtgtatgccaaaaacataaaaaaaaattatgattgttcctagttgtctaagtttctgttgttattatcaccatcacacggttatcaccgtcataattaccatcactctcaccatcatcattagcatcaccatcaacattaccataaccgtgtcatcatcaccatcattataatactgttatcaccattgtcattataactgtcaaacatcaccatcatcataaccatcaccgtcactatcaccaccatcatcatcaccatcaccatcattatacatttgaagttacagccagtagctacacatgacttacttcatcttgttttctgttatttcgtttcagtttgattgataatgcactcttccctgataaaggagttttgtgtaggcagcactgattcactagatgcaaaagagttctgattatgtatttgaaattataaaacggcatgtgagccaaggcaatttaaattcgaaaataactataagcagctaacactttcatttaatagacatataatggaccttcattgacattctctaatttcttacattaatattaaccatgatcggccgggcatggtggcttacgcctgtaatcccagcactttgggaggccgaggtgggcggatcacaaggtcaggagatcgagaccatcctggctaacatggtgaaaccccgtctctactgaaaatacaaaaaattagccaggcgtggtggtgggcagctgtagtcccagctacttgggaggctgaggcaggagaatggtgcaacccccgggaggcggagcttgcagtgagccaagatagcaccgctgcactccagcctcggagacagagtgaaactgtgtctcaaaaaaaaaaaaaaaaaaaaaattaaccatgatcattttaacatctatgataaatactaaataaacaaggtcatacatgtctcattaagcaattttgggttttcactattattttttagaggacttaaagactaaaagaattattcagtatctctagtcatataagctttatttagcaagtgagtgaatatattactttaatttggagtattaaagtactagcataaaaacctgaatggtagcatttcataatctgtattccttttcctgttaaagttttgtcccttacttaaaaaaaaaaaaaaacacttaaaaaaaaacactacttaaaaaaaaaaaacttacttaaaaaaaaaaacactacttaaaaaaaaaaacactagcaatacaagcagacacaagttacattattctctgtattagtctgttggggctgtcacaataaatataaactgggaagcttgaaaacaacagttcaggaggctgggaagtccaaaaccaaggcatattttgtgtctggtgagggcccactatcttgctcatacacagcgctttcatgttggatcctcacatagtggaaaggtcaaggaagctctctggggcattgctctaaaacaaaggacttagtcaccttccaaaggctgtaccacctaatccccccatgttggtgcttaggtttagcatatgaattttggagggacagaaacattcagaacatagcatcctcctaatttgggaagagtgtaatacagtggaaataacttacaatttggaatcagattatctgcatttaaattctacaatactgtctaggaaatacgtacccatagcctaagtccctttcctcctctgagcctgtgtttcttcaggtataaaatgggcgagatcataatttctaccccagaatgttagtgtgaaggttgcatgaaatacataaatgcgtctgtcctgtgtattgattttgcactctcttatgcacacattcagaaatggaacaactgcatggatgtgaaagtgctttctaatctctgaatggctacttagactcataactgtgtctgtagatggagaggtacttacatttttgtctacatttatctacctcagagggctcaagtaaaatgtagatgaactaaatctttacaatcctattaacacctttggtaagatttaatgcattaaattaattgacggatggatggatggttgaataaatatctgaggtgagatgaaggaaactattgatcctgaagttcttaagtaggaaagaattccccagttctattttgatttctgcctcttatctcagctggttcttctgttgggcacctccagaagcctcacttgggtcttctgtgaccaatgaaggctgctgtgggcacagggaggcatgggctgcacacctcagggtacctaaagcccatcccttaatttattatgcattttactaaaatgctatgaaaaagttccttaagaaagaaaactgatgtttagctccatcttgtttaaatgcaggtctatgcctgttaaatcctgtgatccaactatctgtaatttgtaattatgtagtatcacatgaatcccttgttttacaaatgatttcatctccaagtcctgagaatattttaaagaaaattttagaactaagcgttgcaagtcttcccaaagaacactcactggatggagaggctttttgagccagtgtgtgaggttaagactctagccaaagacacctcttttttactcttggtctaaaactcacagctcccaattattcaagagcattaggagcccatgcaaggatttctgcccatctccttcccctcacaactacagagatttaatctggcaaaatagagtaacactctctcatacttatactattttgtgatagaacttttcttgctttgcaagataggacactgatttcttattccagcacatttaaagtactaaaaagtgccagttcctagcttgtattataacacttcttaacttccccatacagggtctatgtttttcttacaaatgtaatgtaaatttctagttgtgtgaaaacttacaataatttgtaaacaatactaaattatattaccaagctgccttatttctccttggaataaaaatacttatacagaattaactgttgtagcaactacatctttaattaaggtacctggaaaatctgtatcttcttacctattcatggatatgaatattttcttaattgctgttaggttcttctgataagctgtcatttttttgattaatcactactttgtttttcacatgaattattgtatatcatttagaaaatgaattgaaattcatgaatttcccacaaaacaggagaatcctggttatctgcttacttaattgattttgcaagcaaaatggcatcaacattgaactgttttctctatagctttccaatttaaatatccatgaaatcaattttctaaaattgattatggtttttcacaactcacaagttttttcaaattctttttttgttgttgtttttcattttcctcagcataggaatacaaaattctggacattttttcctttctagaaagtgaaagctacctgattacatgttcagaatatgttttgactacccttcctcttgagttatgttgttaccataaagcttggtttaaccctctgtaaacacactctaaactcagaataaatatgacacttcacacatagaagttacttaagttagacttcagatcctgaccctcagcttccatgccctcatctaatctagatgatgaggattgaatgccggtgtccatccaaattcctgggttgaaatcctcatcctaaaggtgctagtattaggaggtggggcttttaggtcaggagggtgtggccctcataatgtgattagtgcctttataacaagagccagtagagattctgtttccttcttctctctctaccacctgaggacgcaaggggaagatagccctctgtgagcttgaaagaaagttctcatcagagccttgatcatgggcttccaccctctagacagtgagaaatacatggttttcgtttaagccacaaagtctgtagtattttatcatagcatctcgagtgaactaagatgctagatttaagcaactgctttgctgagagagcccaacagcgattttcctgtccatcctaggccgttgtaaagtcctcagtctgcatgattactcgggagctgtgatattcttggctctcacccactcctaggttgtctgacactatctgtcaccattcctcctgcttccccttatttatggctttacagatgctttctctcgtacttttgtggtcccccaaactcttgttcgatcctcttcttctcactctagtatctccctaaatgaggtcacccaagcccgtggtctcagtgaccctccatccaacagacagaggatttttgtctccaccctcaggtctcttctaacctccatgcccatgtatccactcttgccttgacatctcccgacaatgtcttagcgacaccttgatcccaacgtgcccaaaataacaggggagatctcatgtcccaatctggccccaaaccaggtgctcctctgtgtcctgttttgctaagcagcctcacctctatttgattcacaaactacacgcctcacacccagtctttcaatgaggcctgctcattctcacctcccaaacatcacttcttccgtccttctaattttcttcaccccaatgcccaccagcccagcctaagtactcaggtctcctggggaaaactgcagagcttctaacccaattgtctgccttccatttcctcggctccaagaatggtgtacagagaaatcttgttaatgtttagacacaaacatgacatatccctctttaattgctctacttcccaaagccctcaggaataaggaagaagctcttcaacatagctcttccgcagcctggacctacctactcttccaggttcctggggcaccataggcttcctagctcctggctccccgcaccctgggcctctcacttcttggtagcacgtggctcctccatgcacacagcccacactcaccctcagggcgatgccaactcttccttcaataaacactcgatggtaacttgcttctaacatcttataaatgagatcaaatgatccaattaagtgttcttagcaccgcttacctctcccttcaagccctgattgtgtttgtggaagtacacctaggtgtttgactgccgttaatgtattttccaacactagagtacaagccttaggagggcatggcccattgctgatcttggcattgctgggtcccagctgcttagcctgacctctcaccagaacagacccttgatggccaggtgtggaatgaaaaaagaaatggttccactgctgactgaggccttgcccggggcatttattttccgcagcctgaagtttcatcatttattttataaatgcttctgtcgtgcttgctttgaaacagacactcttctgagcatttcacaaactgtgatggattgattcttcataacaactctttaattcagtagtcatcatctccatcatgcagacaggcactaaggccaagagaagttaaagaacttacccaacatcacagaggtaggaccaggattcaaattcagtcaatcttgacccaaagtccactatgctattgaggggtgagatgggcagtttttctatctctattccctccctctacttataactgtttagctagagaatctgacatgagagacattttaccagaatgataaaattaaattctacagcagtatattttagctcaacaggaaacttgttttgaccacaaaaatgatgtttgtaaagtacaattttaagcaaatgttaacatcagtattgtgatgatttcattggatgagttgaaaatcagcggaaatggtgcaagcaattgtgatatgcaacatgatgtaaatatgagtggaattgctaattgtatcttattttacttagtcatgcattggtgtctgccaccatttgtttatagaataatagcatatttccaggaatatttgaaaatttgctgacaatatcccttatttccaaaccaaacagatttctatttattgatttattcatttttctgttctttgctaaagcatatattgaagcatcttaataaattagaaatttaaatattcattttatgaccatgagggaccagttggtgtgttagaaattgaggattctagcaagtccaaaaataagtgcccatccctagaagttcaccttaaaatcaggaacttatatatctctttaagaaactgaaaggccaaacagcataatactaacagcagttatttctgggctgaagaatcgtgtgatttctcattgttttctccattttttcaatagaacaacttttaattttagaagtgagatattagaaagtatatatttaatattatttatctgagaaatttagtaatctagcaaggtcctgtgttggacatttatttacacatccttttaaaaaataatttgttatttattgggtacccacccctttcccaaggtgtgacacttacatgtctactatatgtatgcatgagagagagaaagagagaggaaaaagaatttgtaattattattgtccaaacacactaatgttttccgaagcattttaaatgaatttactatttcaatcttcacaacagtgctgtcaggcatgttgtacgatgataaacattttgcaaataagaaaggtcaggcaccagaagaggaagtaatttgcccaagggcaggtaataggtaaatcgcagagctggggtattcaaactgcagcccagctccagcctgcaccacaaccatggccgagtctagttcatgtgctcctgaggtgaaaacagtcatccatcaatattaattggtaagtgggaaaatgctgtcctacaatatggaagcctcagtgtctcctatgcgactttcttttccccttatatgcaaagggggatctgaatagcaggagtaagaatgagacctttcaggagcaaaggggaggggagcctccgtttgactgctgaaccagcagcagggtgcttcaaccatgttttatggacatgcagaagaaccagctgcatccagggcttcctctcaggcctttgctactgtgtccaactctctcacctgtgccaggtggtgcttcctcctgtgcccaccttaggggcagcaccctcagcacaggattcaggtcctttcccctcctcagcactgcagggccgcctcacagcccgccaatgcttctgtgctcccgacctgccatcagcatagggccgcccagggccgcctgactgtgccagccgtgggtcaccccaggggcatgtgactgcttcctggtgctttgctcacagagttgtacggacttgaaaaacctgccatctgcactgtgtttcccatccatcccagtatttctaatggtgagttttgcaaaaaaccagtttttccgggagcacctacacagtatcggcctgaccatgcactgctatccaggaacaagaaagaatggtgattgaacaaatagaacaggtggaaagatgttgagacttaagttgtcaaaaataatctccttctggataaatcccgagaagggaggatggtggaggctgggggttacgggatggggagatggggacttgctttcaacagtaggaagtgtcagtacagaagatgaacgcgtgcttgcgatgtgctataggacgttgtgcttaattttgcttatagctaacaatcctgtacctacaatttggtttagaggctagatctcttgccatgtatttttaaccacagttttatttatttatttattttttggtaatggctcacggtatagtattcccaggcgagctagggcaagaaagtcgctccataagtgttcatgctagaaaaacctcttataaaatcatttgttatctttaattcctaaagtttatttagatctctattcatactgttcttataattcagtatcaccaacacccagctccttgaacctagccaaaaactattagcttgttctcaaacattgttgactctgagaatatatagcattttttaaattacactttaagttctagggtacatgtgcacaacgtgcaggtttgttacataggattacatgtgccatgttggtttgctgcgcccatcaactcatcatttaccttaggtatttctcctcatgctatccctcccccagcctcctttttaaaaagcacttgattttattagattatctatacatgttatgcgtcattactgctgtcctgaattcagggttgttgaacagcctatttatagtctattttttagtttatcgtgattattcaggttaaagattgacttgccggagttccctttttgaacattttcctatagggccacagtatcatacaagtatggttagcatggaaatatataagcaagtcaatgagtatcattaaacaaagcaagcacaaaactaacatcctggtgactgacatagattctgtcctatgccgcaccgtgaatttgcttttcatgtgacatgaacttctttgacttcgtttgttttctcttttaaatgagaaaaaaagaaattatatgacccctacattcttcatggctctcaaattttattgtttattttatcaaactctccttccaagtattaagtggacagaataataatagagagatactcttaaattatcccttaaaaaatcaaaatgtctttcagtatcatcatcccttctcttaccacatactccttttttaatggagttggcatgtgagattatagttcttattaaatgggtctaccaaaattagaaaatgaatttaagtgaaaaaaaatagcgggaaaatgccattgaacaaatgaatctaggaagtatagagagcaaaatcataaaaagtcataacttttttaaaaggaaacatttattcagcatttctaagccctctgttgtctctatcagattgtcaggggcaatattggccccctcacatggggacaccctagaacctccgtaggctggagtccaggatggaaacctaggcacctgccattcacatcacagggacaatcatcaactatagggtttcttgatggtatgtgagactgtgggacagagtacactgataattggagagttcttttcaaaagcgagtagcagtgtgtaagcagatagaccatatatccatgtccacaatcgcacacctaactcaggggcaccacgtggtgcaactatcagcagctcccttaacccgtattctctgagaggaaaccccccagactgtgctgctcccagtccacctggcctcacagcacaagcttgcattaactctatagaatgcgcttgacctgaccctagactccgtgttcaatgagtaaagaatgaaaagaacaaagacatgtatgaatattgtatattcataccatattctctcggcatgtactctgtggtagtgcacattctgattcacaaaattgaacaggtgcaattttttaaattttgctccaattatcactttgtactgtgagttaaataatcaccaatctttgtcttgtttggacaaccttgatcatgaactccaaagctgaaggtgtttttggcttcttgaaacagtttgcagtgccatgatcataacaggctttcaactatttgctgctttactttgcttagatttcagtttcccctacgaaatactttattccaaggagtcacacaaaatgtcacagatattttcagatcatgaagacagatatctttagagctttatttttacatttagaaagccatggtcttacctaaattctccagtgttacctaaaccccttccacactctgcaaatctcaaaatatccaataagcagagaaaattattgaggaaattgttctatggcaaagcactagggccagctgattgaattactttcttttagatgaatctgtgtataagaatgtcacccaagagattaaatgggctttatgtggaaagcatctgtgcatttctcaccaggctgggctctttctgccgacaactgaagcggtttgcacaggtgaggggcttgattacaaccccaggagctgggagcaggcccagtttgatgacagttgtagtgaattattagatgcactttagtatttgtgaatttgaaaatagtagtttgttgaagctcattacccatccaattcagtagtaccacaaaaattgacttgatggaatggttactgatactcgattcaggatgtaattttgaaccattaaagttgtgaaatccactcttactagtgagtcagcagtgttgataatgtgtgctgaaaaggcgataattaaggaccaggccgcctcttgattgtttgcaatgcttccaaattctattctaacgaacaactgttatttcagttgactcatttgcggaatacgaactaattgctcagcctcttctgtagtatttctgagcatggaagaaccagacaatgctgatttgattaatgccagtgtacttacagagggagataaaggatgcttttaacttttaacctgtcatattggatttgtgcatactatgtttcaccccgatggcacaggtttatatcagcgcaagccttctaatgcaacaccgactggtacagtaaaaggattttaaagaattttaaagaatgtttctcacaaaagtagaagtagagtgtgaataccaggaacatgtttgtatttaggaaaaggagcttggaagttcacattcttttggttgatttaagctttcttagttttcagcaatttaaaggttaagacaagcagtggatctgggagacaggccatgagagaaaaaaataaatgaaactaaattttcaaaatattcaagaacaccttaaacaactatttttcctgtccctattaaatatgtctcagctcaatatttctggatgttaatcttctggaaggagcatgaggacctgggatctctttcaaataacttaaatataattttatgttctgcagatataaaatatgcgctagatagtgttgtatctggttttctatattttaaatgtcatatcattgcataaatgtaacctaaaatattaacgctgtcattatccatattttattaaaatacccggttattcagcagcataattgcttttggatatttgagcataattcactgctaatttgcatggctcatttagcagagtaattttccatcacatatttgatgaaatcagtgaatactataaaaggattgttttaagatgtctaaaattttaaaatgacaacttaaacgatctttcttgatgctcctacgtagtgctcatcgattacagggtttctgaagccccttcttcatcttgggtcattacaatttgtagctacagtactactttaaaattatgaaatctctaaaaatcaatagaaaagttcaagcctagtttcataaaagctcaagcaaacagataatacccttgctagtcctcaccttctagaaggcatacagtgagttctgtcttattcaccctctcaaatactgcacatacacacacacacacacacacacacacacacacacaagtatgcacgcatagtgaaaatattttatttatctgaaaaatagacattaggagtcttttaacctacattccatttagaggagaacaggaatggtaatttgttatgaaaacgttgatcatgcaaatattctggtgtctctgagctgatctgagcctagaaaaagtgctgcaaatgaaaagaacacaagccaaggctgattgtcctcccagaaacagcatttttgagagattgttgttgatccgggaactcctgtcctactttttgtccaaatgcctgcaagcagcatgttttctcaactgagtattcaatgaggaataataaacttgtacagcagtcaggagaaaagtgttcggagcatgaaacaaggctccatgatacccaatcacaagcaattatttgtaacctgatttccaaaggccctgcagaaaggaagcggtgctcggaagatgatctttggccagctctgaaactgcaggaagctctggtccagaaacaacctggagaaaggttggaggcaggaaggagaggtgcagaacagagacaggagagggcactgatgctcttttctgctagagaatctcagaaaataaaccccaggcaagagcgtgcacaggcacacgggcagcgttcttgtagaaggtagggatgggggcaatgggactaccgtaagacaggaacccttgtaaggcgagggcaccttgggatggctggaagtggaaagagatcatttaagtgttgaatctttttatttatttgtttctgcccccggtcttcttaccgaaatgattccagacagctggtgattacacaggtttccctaattggggaaaatgtaacaggagaaagatacccttttaaatggtaaactactgacaggcaaatagaatgtgatagcaaatgtcagagcagaaaatagtcagttccacagacctctaaaggacaaacggccaggatcccgtccctgccccctgctgacgcctctaatctatcctgacacatttttccactgactccaaactgagtctcaaagtctttctcaagataatgctctgggccagcagctctcaaactccagtttcccctggagggacgtggacagcctgttaagcacagacagccagacagccagagtttcttaggctgcaggtctggagtgggtactgagactctgcacttcaaggaggctgcaggtctggagtgggaactgagactctgcccttcaaggaggctgcgggtctggagtgggaactgagactctgcgcttcaaggagactgcgggtctggagtgggaactgagactctgcacttcaaggaggctgcgggtctggagtgggaactgagactctgcgcttcaaggaggctgtgggtctggagtgggaactgagactctgcacttcaaggaggctgcaggtctggagtgtggcctgagactctgcatctgaaggaggccgcaggtctggcgtgggtcctgagactctgcacttcaaggaggctccttggaggagttcttgttgctggttgggatgctggtgggggaggcatctcattctgagactgcttccgtatggcagcttgtctcctgtggactagagggagcctggaggagaaagccctccgtcctgtaggattttatggtgctcagagcatcctcagcccatcatctcttagagtagcaggacaccagaatgagcactgctccctttgaagcctgcctgaggcctgacaggatgccccaggtgcaagagcagtggagggggccatgcaagtatcctgcagcagttagctcatctggaggcactgctgtctggagcactgtgtgagtaggattatcagtcatttgtccaacaaatatttactgactgtggactgtgcaccaagcagaaatcaagcagacaaacccctgcccttaaggagctcatgttctataggagaaggcagattttaaacataatataacaagtaacagacacacatacatatatatatgatgtgtgtgtgtgtgtgtgtgtgtgtgtgtgtgtgtgtgtaggtatagatagctaatatagacagatgatagatagatagtaggaagcatgatagatgtaaacagatatagacagatttccattgtctttaaatcctccagcatttaaggtcagatgtggggggtcatgcatgtaatcccagcactatgggaggcccaggtaggagaatcacttgagatcaagagttgagaccaggctgggcaacatggtgagaccccgtctctgcaaaaaatacaaagttatatctatcagctatctttgtctgtatctgtcattctatgtatgatctgtcatctgtatatatatatatatatctcgtctatatgtcactatctatcactgctcatctatcatctctgtatcttttttctgcctatctttatctgtcatctacctaatgtatctatcatctctccaggtagccatctgtatgaaatcaggtaatggcaagtgccttggtgggaaggagggaaagaaggaggtggtgatggctggatatggagtctacaatgtcaatgagatttaacaaaagtcccgtaggaagaaggtgagtcacctttgagaatatctggcattctatgcagagggcacagcaagttccaaggccccagggtgtttaagagagagcaggaaatgtgtgtgtggccacagctaggtgtgtgagtagaatgtggccagacaggagattagagaaggacaggagtgagaaggtgtcagcccttgcagcgcctctttagagtctggctttactctcagtgagacaggtgacccctggagagtgtcgcttcaaggtgcaatgtgatctaatttgggttgtatgtgacccctctggacagtgttctgagaatagaatggagcagggaggatagaagcagggaggctgtgacctccatccggatgagcacagggcaccctccggtgctgagatggtcagacatggatctgttctgaaggtaggatccgtatgatgtgcagatgagcagagtgtgtgcaggtaagaagaaggaaggaaggatgggggaggatggggaaagagtagatttgtatggacaaggtaggtgtatgggttctgaggtggctccagcacatggaatagagagtcaaggggaaatttggatcagggtctgaagctctgaggaggaagcctgggctgatgacatgaatttggcatcatcagcatataggtggcattcacatccatgagactggaggagctcattgagaagccacatgtggcgcaagggagagaggtctcaggacccatcctaggtcagtaacaaccctgcgcgttggcggaaagcaatggaccccatgatgacatcagcacccagcaatgcttcgtggaccttttgtagattaaggcagtaaaacaagtttatagttcatatcatttgaactgtgtgtttgcgtgcatcatttaggaactagaacttatttcagtgactgtgttgggctctctccccgacaatctatgacttttactgaacaggagcacatgagtcccaacaatttacgaactttactgacaagagcacatgagtccacactggagatcatttgaagttgcgctcttgtaaaagttctccctgcttttaatattaggatcctattggaaatgttattcataacttcaccccgtgtccttttcatgagtatcattgataaatgattgtttttgccccctccccaaagtacttgtttttaattgctgtgtaatttgagtcaggtacctgggcctgttacctgctatgctgtgtctgctagatggttcagaggtgaaggcgtaggatacattgcctgcataacttcactcctggattcatcttctgttcacttatttttcactgtctttaaatcttccaatgtttaacatacaattcatttctaacttgttttgcaaagttttatctaaacctttcaaaattcttttttggacttaagtttggtataaataaagaaatacagtagttcctccttatctgcagtttcagttacctacggtcaacagcagtctaaaaacattaaatagaaaattccagaaacaaacaattcgtaagttttaaattgtatgctattctgagtaacatgatgaaatctcctgtatcctgcttggtcctgccgggagtgggaatcgcccctgtgtccagtgcattgctgtgtatatgctacctgtttcccgtctcgctggtcagtcagtagccttcttggttaccatattgaaaagacattgtgtacatatgggctcagcactctgtgtggtttcaggcatccactggtagtcttggaatgtatcccttgagaatgacggggcagcacagtcatggcttaaaaacggacactgtgtcatccatattgtactcattagaatagtaaatagaaatcctttcaccaaaatttgagagcagaaatcgtgaagttattcctttgcacttagcattagtcaaactgattttttcactggtctccagctaggttgtccacagttcaacaaagatagtgagaatttgaaacaggttcccaactgaagattaacagagaaaagcaggaagacatgacgttctgtccactaaggaggggaatgaaagattaataccaattcatgtattcagcatctttctatttatttatttaaccgtctctctgtcctatgagccaggcaacaaagcacacattaggcagcatggagatatcatggtggaaagcaggctgacggcatctttgaaaaacttgtgttttgcatcccggggagatgacagacatccaaacaaccgccatatgataacacctcaggcactgtgtactctactgaaacccagatgctctgggaacacattggaattcaattctgattgcagcaatctgtaagaatttacagagcaagtggcatttgagccaaaagttgttggataagagaaaattataaggttgaagggtcaggcggtgcaggtcacaaaaggctttagataacactttgtgcagcgtaaatttatgctcaaacctaagagggaatgggttgcggacatatttagacaagaagctgcatgactcagcctgtattttaggaaaatagcaaaagcccaagaatgaaagataggtaggatagcgcagcaactgtgtaagtaaaagaattaagagcaaatagatgcagggttaatccaggcacaggctcctgttagctgtgcaatgtcatgcaaattactcaacctcacaggtccccagtttgtttattggtttgcattttcctcagcaacatagtaatgatcaaaataaatacaatgtgggggaaagtgagtgaaaacgacttgttgaagcatgtagatgggcctgccacttgaatgatatttattctggatatttattctgggttagtgtcaccgcccatcatgcttgccctcctcatcatcaatttgaaggtgggaactcaattaagatgctgttgctgtaagtcagcaaatagagaataaggccaaaattgaataaaactgccaaatagtttacactggacttactttgtcttcactaaatacctattataggacgggtgtggtggctcatgcctgtaatttcagcagtttgggaggccaaggtgggaggatcacttgagtccaggagttcaagaccagcctgggaaacacggtgagacccaatctctacaaaaaatacaataattagccaggcatagtggtgcatgactgtcgtcccagctactctggaggctgaggtgggagaaccacttgagccttcactgtagtcgaggctacagtgagctgagagtgcaccactgcactccagcctgggtgacagggcaagaccccatcctaccagctctccccaaacctattatatccccaaattatgcatggagaatctaaaacacaagctagtttcacactttggtgacagattatgtgagtacatgccatcgtctaaatgtcagtgtccccctagagttcatgttgaaatcctaatgctattagaaggtggagacttggcgaagagatgaggttgtgaggacagagccctcgtgagtgtgattagtgtccttatagaagaggccccagagagctcccttcttcccttctgtcatgggaaggtacagggaggaggtcctgcctctgaatcaggaatccagtccttcccagaagtgggatccactggcaccttgatagtgaacctccagaccccagaactgtgagccataaacatgtcttttatcagccctcatctgtgatattttcattgtcaccctgaatgcactaaggatgtggtgcagaggagggggttgggaggtgctgtaagatggcttaaacacagacttccagttggctgtcatggtgctttatagaccagacattcgttcaatatttgctgaatgaaggtatgtttgatatgtgtgtgtatatatatatatgtgtgtgtgtatatatttgtatatatatgtatatatgtatatataaatgtatgtatatatgtatatatgtatataaatatatgtgtatatatgtatataaatatatgtgtatatatgtatataaatatatgtgtatatatgtatatatatgtatatatgtatatatgtgtatatatgtatatatgtgtatatatgtatatatgtgtatatatgtatatatgtgtatatatgtatatatatgtgtatatatgtatatatatgtgtatatataaatgtatgtatatatgtgtatatataaatatatgtatatatgtgtatatataaatatatgaatatatgtatatatgtatatataaatatatgtatatatgtatgtctaaatatatgtacatatgtatgtctaaatatatgtacatatgtatgtctaaatatatgtacatatgtatgtctaaatatatgtatatatctatatataaatatgtgtgtgtattatatgtgtgtgtgtgtgtgtgtgtgtgtgtatatatatatatatatatatatgttgccctttctgagaattcaaggagaaaaggaggtgttcatttacagtttagagcactcacacaaaatcaccctaatatcaaccgcctggattggtagcataatggcagactcagatgctcgcactagaagctcctctttagatccatttcaaaggagggtatggattctcaccagcccagaattggataaatgctgtaattgctgaatgccagtagacattacacggcttgttgagttgcctgtgggctatttttctcctgctcatatctgggtcagatcaggactgtggcagattcaaaagtgggcaaagcaaggacaaggagtgagaatgtattgaacggatcattctgcctcatagtaaagggttcccagagttctttcctgcaatggagagagcatgatgctgtcatttgaacacacacagtcaatgtcattgaatcttgcgttttgtctgcttttacctcgaggtctttaggggcctctccgttctcttcctcctgtgttttgcttcctgggggtgattcagcactggcttctgtcacctttctccaacttgatgctgcctgactccctgcccctgaggctctccaggtctctagggctgtgtttctgcaatggtgatgctatccagtcacccaaatgagcagaagctccaaactgttgtgtgttcgagagcttgagaattggcctggccctgcttgcccccccaccagcaactgagagaagaacttgctatcatctgcaaaaagcattttgaatgaaatctctcctttgtaaactctttttgcagagtgtgaagcaatgccgtctgaatttctaagcgttcttctttgtctgttatccctgagagtaagcaaggcttccagaagcaccagcaggtgcagcctctggacctaacctcaaagcaagagtggctcacggagccaaacacgatttcaaaaccccaaagtagctggccccaaaaagagtagtcatcgtttttccccaaagtgcaccaagtcataattccagtgtgttgaaatgttttattttttgttcacaatttggatacagtttttcaagatcctgagaatacaatacccccaagactattgtccaccacagacatgcaaatgaaacacacacacgcacgcagacacacacacagacacactgacagagagagagagagagaaactgtccaaattaacatgcactgggcaatttctgcttacctcctattgaattcggagattcaccaagctatctgaaaatgattaatttaatcctgcaaaatgctatgagactaaaaaatatgagctacaggaccatttgtttttcctcctttatcttttcttaggtcagctgctaaatatataatggttgagagagtataaagaaaaactgcaattaagtatgggtttggcggggaatggagtaggcaatggaagggaaagagagctaccatcatggttacagtgacatgaaattagatcacaaggtgttggggcgacagtcagtcatgatgggaaaaagcactaaaaacaattttcctttcagacccttcttcccttcatttatggccgttctgcatgtgcgacaggcctcttaatgttcctattatgttctttctttactttttatttatttattttttgagatggagtctcactttgttgcccaggctggggtgcagtggtgtgatcttggctcactgcaatctctgcctcttgggttcaagagaatcttctgcctcagcctctcgagtagctggaattacaggcacgcaccaccgtgcctggctaatttttgtatttttagtagagacggggtttcaccacataggacaggctggtcttgaactcctgatcttgtgatccacccccgccctcggcctcccaaagtgttgggattacaggcatgagacactgtgcccagttgcctagtattttcttgcaccaaggaaagaagccatgtgtagaaatgtttcaaaatcatgggagagggacctgtatgagtgtggcataggccagggctgcaggtagcctttagtctcctgctggagacagctgtgccaatcgctctgatggaaagaagggagtaatctggaaatagagacgcaagccttccctgatcaggaatcacagcaaaggtagaaaattggccggatctaaaaaaaggaagaaaaaggcaggtcactgtatgaattcacagagtgcctttcaaaggcttcttcccaaagcctattttttgtaaagagcaatattgcaataggcatttctcaaaagtcctgaagagctacatcccttctgacacatacgtttttcttctaggagtccatcctgtgaaataaaagtgctgattcaacacacatgcatcgtaaggtgatgtgctataaaacttatgagactgtgagaaataataccaaattgccatagcaggacattggttaaataagtaatggtatgttcactcaatggaatagttcacagaattcacacatcatatatatatagatatacaaagagctataacattctcttaatggaaaaaagtggattttaaatgatgtataaatagatacttcacttttatatctgcgtgtacatatctgtaaaggaaagcacatagaaaactaggtgtatttttgtcactaattttaatgatattatattttttcttatttttttatcctctattttctcaacaactgtggaagaaaaacaatgagttcagcctgtcactttacactggaattggatgtatctgacatattcttttgtgtcattgaatgctttttaacatagtatttaatggatattgttatctaatttggtacaactttcttttaacatatttgcaatttttctcaaaatgattttaactaaagaccactatttagctatagtttgttactgatatatatggaagaatcatggtgatgatcaaattgccttcgagtgttgtaggtgtcaccaacatgtctgtgaacattaaaagcttgtaaaatcatggcaaggggaaattgtaagttttcatcttttaatcaatttaactgtatagtaactaataaggaaaagtcatctctttaattagtttgctcaactctgacttttcctgactgactttctaaccaaacacacctgcctgtccaaaagcaactaacgccctccccaggtgtgctgtgggcctgctgtgcgggaatccgccaggcctttcctgttccattcaccttccatcggaacacagcagattcttgaaaagcagtgagtgctaagtagaccctccttcaaagaagtggtgctctaggatggacatttcctagagcctgtgcattttttcttttagactatccaccaaggaagtaatggattagcaagttaccagcaaaacttaggacaagccttacgatttctgagagtgtgtcaataatgtgggatacatccgtttggtttgcgtgttaataaagaaattacataactttgctagactggctggaaaggagcaataacacaacacttaaaagttctgagcttctggagcaagtgaaaataaaatatggtcaattcctgcttctatttaatgttacactctgtgttgaacttaaagtactcttgtttctgtttagcagtgtctgagccatttggactttcttataaattgtctcatgctattttatattcttgtttatggcataaactagaaattttcagaaaaaaatatgttggaaatatattttctggttacagtaatcaatttaaaacatttataaacatggattgatctaaaggaatgttactccttaaaggctgggtgtttggaatttcccaatcatattgaagatgagcttccacagttaggttggattattcactgagtgggaaggtgaaccaaccacctagctcaatcatgatattcacttggcccgggaatacgtctccgccttgttgccattggccactgtatggttgtctatgccaggaaccactcttcctaaagattcccttaatttctgggctttagttctcctaccttactgtccaccccctctctgctatctttgaagacacacattttggcctgtctttaaatatatgactctaaatcatatggaccgtagctgtctatactcggggtcaaagattgattctgttttgtatacctggtgcattcatggagtttggaactgcaaagacatatgaaatatttaaaagttcagcatcccatgacgtgtaatgttcacatcattaatgtaaagtggaaaaaagctaagaagttgggaaactttttaactttttaccatgatatataaataaatagacgtatttatttatctgacccactgggcatttccacccgcaaggctgcagtgctggtggaagcccgtgtacgtgagaagatgagagcactgttctctgagtgtcattaatgttttatcatcttaaggttcacttctcttaacgcaaagtatatgtagacatacactgtataatatacataatatataggtattacttgtataccatatatcatatacagtatgcattgcgtgaatatatatgcaagtggatataaaacatagttgagagatagatccacacactcgtatttggataaggtcagcaatcagctttggatgttatgggataaagtgaggatcagagcataatctaagccttagttaggttgggggaagtagaaaaagatgcttgagagaacagcagcagcttgcagtctgcagtagcacatatcgttattcacacaatgaacaattctgaggtttaggagggctgagtaaaggcctgaggtcacccacatgggaaaggacatggttgtgtttggacccaggtcagtatgactccactgtccgtgttcgtaatgaccacaccattgcagagtgtgcaggtcggggagaaaggcggctggttttcataaaagagcctgagctgctctttggcctcagtccagagcctgtgcatggaatgaacttgctttctacgatggcagcgtgacctaagaagcacagcacagacagaccagctggagacacagcagcctcagcggaaccccacggctactgtacttgagtgaggtttaagtgggtctgcaggaggcaggcagtgatgctgaaaagcagctgaagagctccggagttatgagagctcatatgatctcagatgttgagggctgctggtcttttcgcctggggacccatatgattgcattagccgtgctgcatctgttgccgtcggactcgttggatatcttaccagctgactgaacaaggtctgcgtcagtctatcaagtgatataagaaatttgctagaaaaaagaaaatggtagactcatttcaggctcttggaatgagctaggataagacttgttcttatcccaagattaaggagaaaaatgtgttttttaatgatattcctaaagaatatgtatgctaaaaataatatcaagagaaaattgtcagtgaacccaaaataaattgttaccatgttttttttttaaattattttctttattatcagtctttgagtatcgactgtgcgtggaatttattatagagatctctgtgtttggcgacactgccttttttgatagtcaaaatatgatatggatatccattgccagtgccgactgctccctgtttcaaatgtccaagtattataggaggcaaagggtgtctccctgtttgtttcttcgtgttggcaagcctgagaggcctgtcttcacagacagtagtaacccaggtaccaggacattggatacagccaagggttagaaacaggcacttggaggtttcgttttccaggtcactgacttggatccagattagcttgttgcaaccaagatttttaataccagtgtgatctgcgtcacccgtggagggtcctcccacattgaaaggcctgtgaggagatttccaggtggggcatgacagctctctcatccggcagaagaaagcgcaccactgtgctggcctcattcctctgtcccttccgtggacaggaggcccaaagtacacacccacagagaaatgccatcagggccactgtctctcgactgtcttatcgaattacttgtctgtctgagccatttcccaggcttgagttctgagcaattccctggcacgtagtccttaagcttaagaagatgggctttgtcacatcctctcccaaatgatcctctctgcctgacctctgggttaattcctgatgcctgatttgctggcatccaggccatttttacagccttctctcaagtctgtcatgtttgagatggactctcataccctatctctcacaagtgctgtcatcctcctctttctccttcctcaatggtgaaggtgtgtccccactggattcctgagacctgtctccacccgtaggactctggagctatgctggggcaaacaaaaggaggatgccagatctcaccccctgggcgcccccacctgcaaggctgcagtgctgatgggaagccactgggcatgagaggacaagagcagcattctcttactgttcttaatgctttatcatcttagggttcacttctcttaataacttacattaggagcaaaaataaaagtaaagaaaccatttagaattgacttgttaaggctttagtgcatacagaatactacaaagaagaggaagatgtctgagttagcaccaatgccctcagtgggctcagagtgcagaggtgaggtagacctctacacaaccattaataatgtaagacacacagtaacttccagggaagcctatgaaacaaatgctgtaaaggtaggagtggttaagtctattaaagacaaggagagaaaggtctctggaagggatgtcttctgaaaaaccttggaaatttgggaaggatttacacaggcaaaagtgagtccgtggggctagcatagattgactgcacaggatcaagggcgaaagcaggagcacagcagacagtcgagggagtgatcgccaccacatgggcagaacacaaggttcacgaaagggcgtgataagaaatgaggctagaaacaaatcgattcatattataaagggtcttcagtactaagacagttgacctctttttaagggtgtttgaaagctatgaaaaatatttttagaaaaaagggcagtgcagccaggaatggtgggtcatgcctgtaatcccagaactttgggaggccgaagtgggcagatcacctgaggtcaggagttcgagaccagcctggtcaacatgtgaaaccctgtctctactaaaaatacgaaaatgagctgggtgtggtggcagtcaccttaatcccaactacttgggaggctgaggcatgagaatcccttgaacccaggcagcagaggtttcactgagccaagatggtgcccctgcactccagcctaggcaacagagtgagaatgtctctcaaaataaaaaaaaaaaaaaaaaaaagaaagagaaaagggcagtgctgtgatttagcttccccatgaattttcaggtgattactgctctagataatgaactccccagcccctgtctagccagacacatggtaagtcacaatgtggatatcacatctccaaggaaactgccatccaagagaagtttaaatcctctcttgcagacactcacagcaacctgtactccccacctggtgatgtctcaggtgtgacatccgtcacccagggctactctgctctcaaagattgtgggtgcctctactcactcacacgcatgtcttcagggcccagtaaggtgtctcacactcatacgttgtttatatatgtttgattatgtttgtggtatttcatatcagagttatgtaatgtggtttagagcagagaggggcagggagcacaagtacactcaggagagtttccctacagcacaaggagagacaccagggtttggacgggaacacaggcagtgtgtagctggaagagaagcgagaagcgtactttgcaggtggaacacatgtgacttagtgacctaatgcgtacggtgcaaatctaaatggaggaggggtccctggagtgagagagtgctgtgcactccctgagccctgctttggtcgcctctagtcatgtctttttgagtgcaaccagaaatatacatctgagagcctgtggcctccagaaatcctgaaacaaggggtggctgtgtgccaaacacctgctgaggagcttcatgacaaacagacagatgtggggagtgggaattgaggacgtttctagggcaagtgagttatgggatcttttgattcccatagaggttattaagataaggagataaggcatctccagtcaggggtgctgaggtctaaggctttggaggaaatcattccatgtgaatagtgtcctcaggattatgtgtgcatgcagggacctgggtcctctgagaatatggagccctggtcattgtcctaccaccatttatctcctcacttatctagtttctgtacaaaggtacagggtttatccaactatgacactgtttagccacaaaggcacttgtgtcagtgtgttttgcagtgctatataggaatacttgagactgggtaatttatttttaaaacagaggtttatttggctcagaattccacaggctgtaccaaacggggctagcacctgcttggcttctggtaagggcctgaagaaatttttattcacagtagaaggtagagtgggcacaggtatatcacagggtgagaaggggagcaaaggagaggagaggggggagtgctaggctcttttaaacaaccagctctggagtaaactaagagtgagaacttactcattaccatggggaaggcaccagccattcattcatgagggttctgcccccatgacaccaacacctcccacagggccccacctccaataccggcaatcatatgtcaacatgagatttggaggagacaaaatatccgaagtataagcaccctagctggcatcataacatcgagggtttcatatagtcatttctactttatgatgtgggactggcctagggctctgggagtgtgggtgaagagacctctttggcttattcagccaatgtgcattgagtgcctaccacatgcccagcactctgttacgtgccagagagaccgtgagaataggacaggcttcaatctcgcaaaaatgactaacattaagcaaataactatacaaatcaccaagtgtccggttcaagactacaccaaatgtcatggtgagatctgaagagagttgggggatgagcagaaagaacactctgtggggcgtaggcaggtgaaagttgattttattcagtagcagctctcatcagcagcttcctcacactgtccaccgtgtctcggctgcttactctggcagctgccttacacacggctgcgtgggtggctctcccttgccttcagggtcagcagcttaactctttctctctctgggaataaaccaagccgagctgtggcctggctccccccgaccatctttgcagacggacagctttggctctctctctttctctgggcaccagtgtgcctgtacggcgtcagcagggcgattataccttccacagacaagagcggcttagggccaagtcatgggcttcccatgttatggctacatggctgtgataccaaatggagttacacgcctgtgctacagactcgctgagtcacagaggatataaacatcctacctcagcctatctgaccaaagcacagccatgtgccttataccaagtcattactattttgaaaatgtctgcaaagggtaagtctggcgtgtcaggagagggcatagccaaggaggagctgcctgatcttagagatcagggcaggcttccctgagactgcaacacatgatctgaaatttaaaggagagccagaaacgaccaggcaggtgcagagtaggtgggatgcagggcagatatttctgctgatctccaggtaagggacagcgcatgggatgatctgagtcaggagggcacatggggctttgcatggcgccctgcatgaagtcagctgtttctgggtgtagaaagcaggggatgggggcgatgtgcacctgaagaggctggaaagcagaatgagccaagctggagtgagtgggagggctcaggagactagaaattattttttcatttaaaaaattgactataggagggcacaaggaaaaagctaaaggccgtggctagagtcgcaggagtggatgatgtcaccaagagggatgcttatggccactggtgtggagcatgatggtgcctcagagagtgctcccagaaaaaagagagccagagggagaaaaatcattgtcagggagagagaaggcctttgccagagacaatcatgagtgccgctccgggtggaagaaatgacttgtagaaagtggtaattttggctgggcattgttgctcaagcctgtaatcctagcactttaggaggcctaagcagatggatcacctgagatcagaagttcgagaccagcctggccaacatggtgaaacctcatctctactaaaaatacaaaaattagccaggtgtggtggtttgtgcctataatcccagatactcagcagtctgaggcaggagaatggcttgaacctggtggggagaggatgcagtgagctgagatcatctcatttcactccagcctgggtgaaagggtgaaactccatctcaaaaaaaaaaaaaaaaaaaaaaatggtcgttttgattaaagaactgttgaatgaaaactcttctgtggtacagttttaaatataccatatgggtttttttattttattttgtttcatagttggttgtttttccccagatagtatatacgtgtgcacaaaacttttgaattaaatttctagaaatattggtaactatgtaaatatgtgtatgtgcgtgtgtacatatatatttgtgtctgggtattattgtgtttattttatgtgtgtatacacacacacatagaccttcttttaactgtttttcatgttcttgcaatatgagagttcattgtcgcttttcctaatgtccaaaataagacttggaacagttgtataaactcaaaacatgttcatgagagaaatgatttcacttacaatgtgagtaacagccaattcaaaacataacatgtcaggaactctctgtttgatcaggttgttctatttaattttgacaaaacagagataatgaaacaccacagtacaaatcatttggattgcatgtccagaaaatgcaaaaaaaaaagaaaaagcacatcttttatatggctttctgcccaaattgacacaaaactggtctcctccaagtaataggtttattaaatttcttagtccccctgtgggcagagatcatttaaagcctctcccaatagcagtaatgctttctggcttctgagtcatcatagttaaagagacttaactgcagagggacccccagacatttctctgatgattttctaaagacataagaaatctggcttaatgtaagagaagtactcaaacaaagcgatatccaaaaccattagcatttccaaatgcattttagaaaattatccccataaattgactcttcatttttcaagtcacatacgcgaaatgcatgagtcatacatacagagtgctgtaaaatgttagaacaatgtgttcagcccttatatcccatcggagaaaagtgaggctgagggaggttacatgaaagaatgagtaggagtatgttataaatagaatcctaaaatgtatggtacaattatttggagaaaatgaaacagactggcctgttctatttaagctcaaaggaggtcgtcgtaactgtaaggatcccatgagtcctccatttattttaactcttagcagaagcaaaacccagttgaatcctctgaaggaaatgaatttggcattgctttaaattgcttaatttggtattcttaggggaaaaaagtgggaacaaccagttccttttgccatctctaaaggagctgtccaacattcccactgaatggctttgtgggtttcctgacctagattgagatgctccagaaatagggcatgtcaaaattcccttaagaagaccctttctcagcctgttactcttttactctttttctcacttctcaacccccttgttttttaagcaccaatatccctgacctggcaagctccgtttgatttcaccaggcgtgtgtcctgtgtttctggacatcaggagagaaaatggtcagtgcgctctgaattaatgcgggaagacattggttgatcactaccattatttccccgttcctcattttttttttttttttttttttgagacagtctctcagtcacccaggctagagtgcaacagtgcaatctccgggtcactgcaacctctgcctctcaggttcaaacaattctcctccctcatcttcccgagtagctgcgattacaggagtctgccaccatgtctggctaattttttttttttttttttggtatttttagtagaggtggtgtttcaccatattgctcaggctggtctcgaactcctgacctcaggtggtccgctgaccttggcctcccaaattgctgaaattacaggtgtgagccactgtgcctggcaccctattctcttttagaggtttctactttgaatcttgtctctgttcatgcccattttccaccatttgccccataatctctttcattttccaaactatttgtttattagaaaaccaaatccagcaggcctaaaagaagtgtggctaacagctgtagaagacttccaggaaacctcactccaacagcggtagatcttcagtcactggttgttttataaagggtttaaactgcctggattcagtaaggttatgaatagataagaattgtgtcacattgtaccatattttgttttctgtccttttcctcaggatcattctagatcattctgattaacaggccgtatttctgttttggtctttttaagccactttatggagatatggttgacatataaaagctatacatatttaatgtatacatctcaacaagagatttgctttctcttgccaccataacaaattaacacaaatacaatgacttaaaccaacacgtgtttattatgttcagtaaatagattagaaatctcacatctacaatcaaggtgtcagctgggctgtgttgctctctggagactctatgggaaaaggcgtttgtttgcgtttccagttataaaggtatcagcagctttcttgtcagccaagagggtgaagccctcaatgcgtcactctgacctttgtccacaggctcttctacctggaaccttgtcctcctgcctctgtcttccactttaaggatctttttcattacattgggcccactcaataatctagtataatctccccatcccaagctcagtaagcgcattgttctgcaaagtcctcatgagccatgtcaggtgacacattgacagtctccagagagcaggacctcggggcttggggatctgtctgtagcaggtatgattctgcctcccacaaagccattcagttgaattcttttcttctaaatctcaactgaaacaccaagttgttagagagttcacaatttcacctaatttgtacagtaatcatcttcctttaaattacgtagtttgtaatgaagaaacaactgagtttatagcatcaactttgtgtcagatgagagctataagattagctcctggccctgtagacagcgatagaataacaacacagttctaaggccaggtctcatttggaacaaccccctttcccaaacaaacaacaaaagtctatgaacatttgtttaacgcaaaaggtcaaatcaggaaattcatgtacaaaaatcgacttcggggtacaattcatttgaatggcttcttcatggaaaatggattgtataattggtctaaagccctcacccttgcttctctataaaaggaatctgtgcaaggctgagtgtgatggctcacgcctgtaaccctagcactctgggaagatgatggggttggatcacctgaggtcaggagtttgagaccagcctggccaaaatggtgaaatcccatctctactaaatatacaaaaattagccaggtgtggtggccggtgcctgtaatcccagctactcaggaggctgaggcaggagaatcacttgaacctgggaggcagaggttgcagcgagctgagattgtgccagtgcagtccagcctgggtgacagagcaagactgtcaaaaataaaaggaatttgtgcaggacttacgcattttttttaaacctgaattacactaggctgctatgcatcatctgtttatcttccagctcggtgtttttgttgttggttttttttgtttgtttgtttgttttttgagatgaagtctcgctcttttcacccaggctggagtgtgatggtgtgatctcaactcactgcaacctctgcctcccaggttcaagcaattctcttgcctcagcctcccgattatctaggattacctgtgcctgccaccatgcccagctaagtagagacagggtttcaccatgttggccatgcttgtcttgaactcttgacctcaggtgatccacccaccttggcatcccaaagtgctgggattacaggggtgagccactgcaccgggtctgtttttacaaatcgcttcatatatgctagagcaggggtcagcaaactagtacctgcaggccaaatctggcccatcagctaagagtggctttcacattgttaagtgactgaaaaaatacaatcaaaaagtaactattttgtgacacaaaaaaattgtataaaaattaaaatctcagtgtccgtaaataaagtgttattggaacacacccactgccattttatggctacttgccaactacacctgcaaagttgaacaatttccaacaaagaccatgtgacccataaagcctgaaatacgtacgtactccctggccctttacagaaatatcctgttgactgacacaaaactatcattgttctgagtaggtatttggaaatacagatgagggtaaagagtggatgtgggtgtaggtggtggtagagaggggatttatttgtgatcattattaatgtaggcatgcaaataaagtgcaattccaggctggcacagtggttcacgcctgtaatcccagcactctgagaggcaaaggtgagaggatttcttgaggctgtgagttcaagaccagtctggacaacatagtgagacccccagtctctacaaaaaattaaaagattacaaaactatccagatatggtgtgcacatatagctctagctactccagaggttgaggcaagcggatggcttgagcccaggagtcggagactgctgtgagctgtgattgcaccactgcactccagcctgcgtgaaagagcaagacactgtctcaagaaaaaaaaaaaattccacctggttttttcagtcagaaccgttcataagtaatgcgagtgagaaaatatatatgttcaaagcagcaacaaaacaagcattgattgcggttgtgaaaagtttagcaagtacatgcagcttcctacattcgctgatcttttgtattcatagtcttctatcaccatatgaaatggaaacttacaggggattgaataaatatcagtgcagtattttgagggctttggatactattagctatgtatatattttacattaggatcgtatctgatgtggaaaaggtaggcttgcttctgtgcttaatttcagtgtatatctatgtgtttgtagtttttaaattttctatgtttgaatttaacgttttttgtatgtgatatttgtgtgtataaaaataattattgatttttaatatacaaagaaactaatgatttttttttttttttgagatggagtctcagtgtgttgcccagggtggagtgcagtggcgcgatctcagctcactgcaagctctgcctcccaggttcacgccattctcctgcctcagcctcccgagtagctgggactacaggcgcccgccaccatgcccggctaattttttgtatttttagtagaggcagggttttaccgttgccatgatggtctcgatctcctgacctcttgatccacctgcctcggcctcccaaaatgctgggattagaggtgtgagccactgcgcccggccacaatgattttttaaagtacctgtaagttcagtaagtacaggtgagtggcacagactgggggtttttgaatctagttttttagacattctccgtattaggcaaataagtatgtggcctatagaatttgtaacataatctcaccagaaaaataaaaaaaggtgattaaatatgccttggagtcagctgtgtccagctgtcaccagccagtactacataaatccaagcaaagaggcaaatctgagcagtgtacttctcttacagaagattatttcaaacagtggcataaacactgttgtaattggttacagtcaaggtttggcttttaacttaaagtggatcctgtacatttttaaacctgagagttggaatagagccccctgacatcagaaagcttgactatgtatttcatctggtgttgcttcttccaggtaatagaataagtagggaaatgctctctacacaggtgacccatttcgtaggaaatcgtctgtgtagaaatcaggtcctcagctttaccaagcagctgcggcgctcacaggcaggcccacacgcagcaccacagttcaagttcctgctaaaagcaatttgcttaaacccttacagattatctacactaataagcatcattttgaaaatagattttgttaccaagatgcaaaataattattcagtgcacaaccacttgtagagcacatggagaatgtgcttcaggtacatttacatgtgcatctctatcatctttcgacccttgatacaggtattttcgtgtccagtttatacaatgggtaacagaggttcataaacatgatccacctatgttgcttcacctagcacaaagtcgagccagcacgcaatcctgtatcagaagcatcctaatccagtgatgcttatgccactgaaaaactaaatgtgtcccttgcgcctctaacgggcaggagctttaatatcttggaatgcttttattccttagtaagcacataaggttttcaatagtgagaaataaaacacatgattgtttctgacaactaaactgcacgttgtaaagtgaaatggatattttaaacagcttaaccagaaattgattgcatcttatttttaaaatgaatgcactgctttcttaaaacataattttattccatttcaaatctcttttgcagttcttgtcatcaatctcataaatggtcctcttctttactttggtaggaaaggcccaggttcttagtcctgcaaatgggatgctgggaatatagcttgttaccaagcatgagaaacagtttgttggcgtctacttcaggttacatagaattcgtaagtcttgtggccgggcgccgtggctcacgcttgtaatccaagcactttggaaggccaaggcaggcagatcacctgaggtcacaagttcgagaccagcctggccaacacggcaaaaccttgtctctagtaaaaatataaaaagtagccaggcatgatggcgcatgcctgtaatcccagctactcaggaggctgtgggaggagaatcgcttgaacccaggaggcggagcttgcagtgagccgagatcgcaccactgccctccagcctggatgacacagtgagactccgtctcaaaataaataaataaataaataaataaataaataaataaggaattactaagtcttcaaattgtgaaacacagaattttatcattttcctatttcttttccttttttctgattcattgtgattaagatcttgatgaaaagaactaagagatcaaaagaatacctcctcctgcattcaccattaataaaggagaatgaaagtatcaaatatttttgaaaacattcattccatctagggatttagcatttatgtttgggcaaagataaaatcatcttgatcgttttaaggttcaaagtcaattaatacatggcctctgttttaagcatctcaagatgaaggatttaagtaatcggatttcaaagcgggtttgatataggacatttgctctgttggtttacaagggagatttttttcctctttctcttctctaggctaactggcatgaacctcccctctccagttatcagtagcaagaattggctacgactccatttcacctctgacagcaaccaccgacgcaaaggatttaacgctcagttccaaggtaaggatgctccatcttataagaaaaaaaaaaaacagagcgtaatatattttgatcctttctagccatgaaattttaggagttggataaatagcttgaaaatggtttctaattcttttattcacagttatctttggaaatcatatagtcgacagctgggaacttattagtaaagctatatcactatcacagtatacaggatatgtatagtttcttgatacactggaacaattgctaagttttaatcaatagctatttattatcattgattttaattattatgcatctaatctgtaaatatccacagcagtttggctattgtatttacattcatgttaagcatgctatagcatataggttgcatgaaaatgcacaaaaagtattgtaatatcacttttaatcctaaaaggtcttcacaccacataaatgcatgattcagtaatttacacacaatgaatcttaaaagaaagattctggatttcctgcagctgagcaaaatggggagtctgtagtcattaggacagagcttggtaatgaaatgttctttttctctctggtttctaaggtttatacctagatcatattgtatcatttcctgtatgtttctaataatgagtaatccttattaacacagcaaaaaactattcagtttattaagcagtctcctaaaaaccattccacttcgatttccaaattaaaataacatgactttgaaaataatggaccttcccaatcaaagtgcctaagctttccccacattgtgacgatgagaacgttgaccccattaaggtagcattcgctgaacacctgccatgtgccagagaggacaccaagccctgcagtgccagagaaattacagcatcctccatgctgcaggaactagcaggtcacggagacagtttgcagtttgtaaatacctcccatgaaagtcagaatgcaaagggatctaattatagctcctgctggagattttagtaatttttcaacaaactggtctaaatatctgttatcttacacattttaaaatccataatgctttcatcgtttccttcaggatgaccagtagagaaacaagggtcagttgcggggaatgaaatgcagagggtgctgagaagtacacatcggaaccagcagtctttatttgccacccagtccctggggcacatgatgtacgcagaacttcctgcctcagaatccaggggcaaattcgtttcaacaaaatatgttttttttttttttttttttttttttttgccaggcggggagtgggtggcagtggacagagtcttgctctgttgtctgggctggagtgcagtggtgcagtcttgcctcactgcaacctccacctcctgggctcaagtgattctcctgtctcaggctcccgagtagctgggaatacaggtgcagaccaccacacccggctaattttgtatttttagtagagatggggtttcgccatgttggccaggctggtcttgaactcctgacctcagatgatctgcctgcctcggcctcccaaagtgctgggattacaggtgtgagccaccgtacccagcgccaaaatatattttagacttcatcaggaacattgtccatcttagattgccttctgatgttgccggaaggttcttagcttgatcttctttggttgcaaagaagctgccctgaaattttattagagtgaaattaatgtgctttcccttcacctggagccaggccaggccgatcctccttttccatacctccccatatctgccgttatcttgtgactgccatatactgtggctgtagttagaatggagtaaaggtgggatggacgtgttggcggtgggaggtgggtgcacacccaggctgggtgggtttgaatgaggaagactccatgtggtctggtagagaaattctgtctgcactttctcttcagtgatccttatctatggatatgtccatcccgtaccagatttaacataaccataagtcaatatttacaaggccaatggactgatcctatagtcagttaggttgattaacagatttgtctctaaaatgtaaattgatcttttcctagagctctcagtaactgaacaacagtgaattaaagaaaaatttctaagcgtttgtttctcaaacctgatcagtgaacttggcatttgtatctgtaattgaaagaaaggttaaaaatggaatatcaactttgaagctgctccaagatggtagatataagaaactcattggttggcagaaaatagcaatcacttagatgtatcagacgttgattttaaaagttaaaaaaaatatgtaattaatgaaagtattatatagagtatataaattatataaacaatacaactacattatagaattaaactgtacgtacgttatacacacttcattcttgtatatattatagaagcataaattataattacattatttatatatattctataatatatgcttaattatatatttaagtataaacatttatatgtataaactgtatgtagttatatttaattaaatttattgtattatatttatataagaaatatataaataatttatatatagatgtagatgtgtgttcgtgtatatatatatatatacacacacacacacacacacacacacacttcaattgtatatataaggagagaggagtcaaaaatttggcatttaattctaaaacggtcaaaaggtatgaaggtatcaagagaggtaagcctggcttaacagtaatgcattaggaaacatttcaaggctgactttaaagttcagctccaagacaacacggtacaaggaagttacctttttttcattaccacatggtcctcattgaacaggggacttcctgcttaaaaccacatttacgcagactgcctgtggaaggttaggttcagtactagacaccaccctctgaagaagaagaaggaccagagagaggaagatgacaagacccatcagaaggaggatgtgaggaatcttagagggcgcatggtgcacagtacgcagaaaggcactacgattatttttctggatccagagggcagaactgttaccaaggaatggaagctccagtatggttgctgttgctgattctagaacaaacctaaggacagctggagacagagcaacagcttaggatgagatgggcccttctcagagtccctgccagccacccagccctccacacggggctgtcctggttttttgcgagtaagatcatcaagtttgttccttcagagggcaaatgtgaaaccttctgtcaagcagggaaaacatttgttcagctgaatcttccctcttgtctataccgagattaaaaagcatgaagcccaaattgtattgtaccttttatctgaactaaatacattaaagaaggaaagcctgatattatttgtgccaacaaaaattgcgaaacaaaaaaaaagcatagtcgattgatatttggggactaataagacaacaataataattatagtgaaaacttacataatgtaaacattattgtgttattttcatctttccaaatgttgtcaaacaacttgaatcatatatatcgtatatttaacctgaatcatatatatatgatatatataagatatatatatacatataaagtggagaagaacattttaaaaagaacatacatttttatgcttcgcatatattataatctttttaacgttattgtagtcacgtttatcatttatggtcatttgtaagagaacaaaaattccgtcagtgttacttggattgatacgattgcagattatctggaattcctaagaaaccctttgtggttcctagccttcctcatattcaatgcctccccagcccaaagcaactaaaacaaacagcttgaaattccaaattttaaaacataaagaactcaataatgactatattttttgcactattggtagaaatctgaattgatatgaccgttttagaaaactgttttaccatcaagctgaacataagaaacatttcaggcatgcgtccaacagaaatgagtagctacacacaataggtacagagaatgtccccaggagatgcgagcaccattgtcaaccaccgcgaaccacctcagtgttcattaaccatagaagtaataaacaaacatggaaagagagaaactacctctacatgtaacgacatgggtgactctcacatacaatatttcgtgaaaggaaaaaaaaacataaaccgtatgattcgtttatatgaaatcagcccactggtggtctctttctatgagaaacttctttgttttccagcgtatgatgcttggacagaattgtgtaacttctcaaagacaaataatatattctttttaacttggtgcttttcttggtcaaataaatgacaaccaacataaaatattctttctactcttcccttacatttttaactttcatctccaaattctttattctcggagtcttacactttcttctttgactttcacctctccaattatatcatcaagtcatgtcagaagcagtagtaaggttgcttgacaagtaaaactgttctacagttgctactcttaaaatctattcacttttaaaatgacattgtgaacaaaagtagtagaaaacgcaggggaaaaacccacaatatatttgcaatatctgctgtatatattgggctgtggttgaatgtaagatttatgcaggacacattatttctttaaatcagctgaaaattgagcccattctttatatgttgcctccatcattaattataattaaataagtgccttgtaagcacaatccatcatctagacgttttcagtgtctacaagataaattttttgaaaatatattaatcttgaaccatgagggccccctcactactaaatagtcatctaagtgttgggctccagttttacacacctttacccggctgtttataaaattacaattttcataaaatgaaattcccattgattttctgtaactgataaatcatcatgaaagtaagtgtttgtaataaaattccaatttttatagggaacattcatctcataaatcaagggaaaccctgacagtggcgataaagcttgtgttgacacaaataattagtttgtttttaggttatagttccctataactattgattttcccttttaattaaaatgaagacctttataccaaatgaagactttcatgttattagaaaggcattttgagttattgaaagccccatgttcccaggttaattctaatttggataaaacgtatgcattccccattctccaatgctcacattttctgagatttgaaatgcagtttccagagctctatctaggagtatacctggattctggtggcatgcatggttgcctctccttttaaaacagtgtaaaaataataacaaccattatctagaacctggaaagtgctcagttacgtttagcggaaggaatggaggaaatcaagtgctcctattcccctcaaggttccacggaccactgctctgcagagtgtctagaaacctccacatgggcctcctgcctgtttccatggcagtggacctcccttgctatcttgtatttgagggaactattaggtaggtatggatgcatgaagtattgtttcaatcaaaataaattactgaaatatattataacctttaaataattcttaaaaccactaaacctccatgaaaaaaaatagtttttaataatataactcattcaaatcagaaacacgtaaccacttttcctaaatatctactttaatttctctcagaacaaaagattcttgtaaagtctcaatggcacaagttttaagattttggaaaaagtgtccatctatgggttccaagcgactgactcttactctgcacttttcattaagtacttacgattagccagtaccccttctacctgtgtgtcttgctaccttgttttataaaatagaaataatcacgtccaccttggagaaccatggtggacttctagacaaacggaagaaaagtgggacaagggttttttctagggctgggaagtgggagggagctcgccacactgaggaccttcctcagactcaatgcctccccagcccaaagcaactaaaacaaacagcttgaaattccacattttaaaacataaagaacaaaacaatgactttttttttgcactattggtggaaatctgaattgatacgaccgttttagaaaactgttttaccatcaagctgaacataaggaacatttcaggcatgtgtccaacagaaatgagcagctaggcacaacaggtacagagaacgtccagaggagatgcaagcgctattgtcaaccactgagaatcacctaaatgttcattaaccatagaagtaataaacaaacttggaaagagacaaactgcctctacatgtaacgacatggatgactctcacatacaatatttcatgaaaggaaaaaaaacaaacgtatgatttgtttatatgaaaaacaggaatttgcaaagctatgtgttcgcatggatgaccattagtaaaaaaaaaatactgtgtctacataatatttctgtgaaaaaagtgttttcaaagatgatcagaacaatctcttccaaagaaaatgatggattgtttagaatttgcttgcaaatggggccacataaaattacctagagaatccctcctggatggcatggggttattggatggcagaacagaaagaagcttcaactctcatgcgagaaatggagagattaagggctgtggctctcgtcatacagcttgcaaatggcagaaccaggatgtgagtacaggctgctgtgctcttggcttcatgtcagtctttacaactgtgtttctccaccgacttgtcatactgctcccactacttaacatcagaacgtgttttagttgaggggtggtggatagtgagttatttttatgaaataaaattcctaatgaaaggaggaactttttcggatagctgtaatttagtcacagctttatttctcagactggcctgttccaggcagaaagctgacaggccagtgtcctgacccactgtactcagtcctcttgggctggccatgtgatgacaatttcttagccccaccctattgaccttcatcaaagaagataaaacaggcatgattattttgtttctctcggtatattaaaaagtcataaatgtaaaagttcattctgaacagcttctgggtatctggtaaggataggagaaatacacttaaatattagttgtaattattttgagtagatattggggataatttcttactaatgttgaaacaagagaataaatttaagaaagatatgaaatattattcatcagagatgttaaattaatgaataaaaatcccacgcagactaatggaatacatgaacatttgagttcatgccagaattttaattcagtgcacttttatgtattgatttattttaaagttgtgtctctgaaatattaatgcatgacaaacgtttactgttatatataaaaccactttaaatccttcctttctctaaactttgaaatgtggttgacattggataattgggggccaacaatggtatccagtaaatctcagctatttaaaacagattaatacttggcagtgactggtagattttaagttcttatgcttcaagaataaagttcaggtaggttatcaatcccttcgtaaattgttttcccgcagtttatagttttgtgatgtggaggaagaacttattctggctttcagcatatcagtcctaaactgctattcttttcagcgtatcagccctgagctgctcttattcttcatgttctctgtctcatgcaggcaatatcgttggccaaatctgcagacaatgtttcatgtttatttgctaaatgtccgtgtgtacctcttgtaggtagcggtgtgctttggaacggtaagcatgattgtgtctactgtacatgtgaggaagttgtccaccaaagtcttcagcatttacattgaccaactggtcatgaagtctggcctttccccccggcctgctgctgtgaccaggttggcgagctgctgtagtgactgctccccaggcaattacctacatgataatgtggggaaaccacagattattcacagctgtagggaaaccaggaaaccttcaaaggcacaggttacattgcttgttctcttaatgatctgaatcaggcttctgaaattgaatggcgaagctgttgcttaatgaaataaggaatctactctgaggaggttaacgtccttactccagcagctgcctgacttccccggggattcatgccccttgtgaaaagacaaatgcttcagagtctcagtggagtgctcagaatgaatccagagatgagttccaaaatggttgaggagcaagcgtagcaaaagatgaatgtggcaaccactgaaaattgtgatgattagatcctgggcgagtttcctgttgtacacgtgcagaacctggtttcctcagactgtctcagattacgtcaagttggcatttactcacctgtttgtaagacctttctttgtcagagcaattttgaagaaatgtctcagagggttccctcctgctggtcagctcagtctcagtggtagtttttaaaggctcatgagattccaaccaggttcttgcagagctgaccatcatgttctttcctgttgtgaaggtggcatattctcctccaggggagccttgtagttaacttttgaccatggcatagtctacaatttactaccccaaaaaatataacagagaaatgatagagttcaaaatggtttttcatagatattttgaaatttgttttgaaagtagtaagagctttgctttctcaagacacatatctagggctacaattcagcttgtatgtccataatggttgttaacatgttgaattatttgcatcagatgataaatattcactgcccggagaatcctaagagcctcccagccccagctactctaggctttactacaaaaggcctcagccctgtcctcattaaagcccttagaaacctcagtctgcttcaggcccactcaactaaagcgctcagcatgtttgaacaccatcccttactctatctgtgatgagcatttatcagacttaatgttcagttccatagatatatgaaacaaaataaataagaatgtcattcattctagagaaatatacaccaagtcttgagagtacctacattaccctaatgctgtaagtcactgactcttcatttcatagcccagacaacgtttcatgtttatttgctacctgtctgtaggcatcgcttgtaaatagcatgtgctttggaacttgaagcattacaatgtacactgcacatgttaagctgtccaccacagtcatccacatttacattgacaaactagtcatgggagtctgacatgaaaataaagaaacgaatctttggatctattttatttatttatttatttatttttgcctccaaaaagtttagaagtcctagttaaaatctagtttcctagacttttttcctggttaaaatctttctatggaataaaacctcatgtaattcattaacctgggttccaaatctggtcctgctgtgccctgtttagtaatcagtggaagcccacagggtatcacaggcagagtagatgctctccgtgctgtgtccccatccgccttttcaaactcatcttttgatccgtattccaaacttcccatgctcctgttgcacacacctgctgcggcttgaacacgtcatccctgtcctcaactcccactcccgccagaccttccatgcccttgtcaatccagaaaagtgacgagacaagtctcaatcatttcaggaggtttacttgccaaagggaaggatgcatgctggggagacaggtctatgtccttctcggaagaggattgtgagggctccacattgaaggggaaagggcaggatattgagaaatacacaattttcatgtaacgggggtaggggaagataatcattcatgcctctgtctgggtcagtgattctccaattttttatgtaaggtgacaaagacaaatggtgcagaggaaaaggcagggaatctggattttacatacgataacatagacgaaattggttagaggaggaagcagatatgcatttgtgtctggtgggcaagggagtgacggcagctgtaaagataaacttatcaatttacatcgccatggtgaaattttaacagaaacacctgggagtaacgatcttgcagctcactaggaatgtctttatgggaaaaaatacggagaagtgtggagcttttcatcttgtaatcacctcatttaggaaccaaaaaggggaaggaaggttttcgagacctagttcccagcttgacttttcccttcggcgtaatgagtttgaggtcccaagatttaattttctttcacaccctgcaaccacccttgtttctttccattattctttttgaagaaactttttccagtcttctaagtcaatatcaattacttattcagaagtctccacataatacttattattttctaacaccatcctaatgtcacactattccacgcaatgcagttttatgtgtggacggcaaattatctatttttctaaagagcaaaagcagcaagttgtttgttgcttccagcatccaggaaagccatctccagagaggcagaattcgcttcatgttccttgaataattcctggaatatttcaatgcctgagcaaaataaaaccacaaaaaaagggcagaacactctgcattcatgaaaagagtcgtgtagcacagtagagagatgctggcttttggagcctgaagaccttcatgacactgagcaagtctctcagttcctttaaaggtttgtttatccagcagtgagatggagctaagcacagctgccatacagggaccatggcggtcaagtgagacaagtgtgctaggcgtatgttccaagggtggcgtggattttactgcttccactagttgtgtagtctgtgcctcgtggtatcctgtcaagaagatgagtgcgacatgaggctgctcagcgcattcgcacggaaatactctgttatccattgcagtcataacacatttagaaacgcagaagtaactcttcacagtgaagaagttgggtctccttatatgaggagttctctgtttgttttttgttgttgctgttgttggtgtttttgtttcgtttcgttttgtttttgttttttttcttctctctctctctctctctgatcctatgcaagcttctcaggtgattaaactggagtgctgactctgagtgtaggtgtatgggagagacgtccttcaggacgagcagaaggaaaagtggacctgggcacgtcctagggtgaagcactactggcccggggcagaggcaatgcgtcactttcttcaccatgtccacaggcaggtttattttattttcagtgcagtgccaactatccatcagaaatgtttttaaaaatgtataaatcatagaccgcaggcctattgtaagcattagatagaggagcacaattaaaaatttactgactctttctgcaggagtttacaattttacttatagttcttgaaaaatattcgggtcagattcgccactgaaatgttaatgtaagttatggactgtctccctggataccagatttcataaacatttgtatgaacgttatgtttacctgaaatcttaggagtaataaaatgtctaggtgagaattaaatctatctacagaacatccagattggaatgatcacttctccttaatggtgggctatagaagactcactttacagaaaggcgatagaagtgactaggtggatagacaaatagactgatggacaggattcctcatcagcagagccaggtgcaccaggatgtgaggcaagaatgtgctgaatgagtgtgaagctgggaagaaaaggagagaattccagcctcgaaaggcaatttgcagggttaaaaaaaaaaaaaaccaagattctttggaaaaagtggaattagatttgccatttgtgggaaataattatgaaaaagtaggtttgggccagaatatgactcacatggtaaggaattggaacctttacctttggtccacaagagtttgctaaagccgacttgagcacatttgagaaagaaagggtagaagggccatggagggtcatagagaaatgggcatattcccacaaataaattcaaccaccactgggtattttcttctttctcagtaagaatgcgcactcagagaggagaaattttgtgtagtgttaatttcccagttagaagtttagaaatccttattacttttcagttttgctagaagttatctgtctgcactatttgcactgaataattcaggttctaacaaacagttaatcttgaagtcaaaaaatgcatatcataaatggatagaaataaatgtgcctactaaaaactgtaaaacaaaaggaaatgggaagtacattttacttggtaaatatgtaaaattgctactccctctgtcatgatgtaggtacacaaaatgattaacttcagaagctggatgggataacctggccctatatgccatcctgtgatacattccccttcggtctcccctctcactgtcaaacttcttgaaagggaagctgcaaacctctttaaacatttagtctctgacctactaaactctaccgcatggagtcatacctcctctaccttcttcttctgtatgttttttttttttttttttttttttttttaagacggagtcttgctctgttgcccgggctggactgcaatagcacgatctcagctcactgcaacctccacctcccagcttcaagtgattctcttgcctcaaactccaagtagctgggatcacaggcacctatcaccacacctggctaatttttgtatttttagtagagacggagtttgaccatgttggccaggctggtctggaaatcctgacctgaggtgatccgtccaccttggcctccaaagtgctggggttacaggtgtgagccactacccctggccccctctatcttcttctgatcccagtttcctcccacccctgggcacagaagctgagtagggctctgcctcatcctctctgctatactctcctccactgggcactctgttgcctgcatagcctccctaagctgatgctcaaggtaaacacagtgattcttcatttcactttttcctttgctttcctttgtggaactaggtaccaagtcttttagactcttcgtttgcagtttgttttgtttgcttcgactcctcttccccaatacatctcgtaaaatctacatcccaggtccctacatttgtctctttaccagcatcaaatcacactacctcagcccctgctcgtcctccttcctgtgtgtgccatataactttccctgtggcagaaatccttctcctttccgtctgtatatcacatccatcggtgaaccctcctctgagtattttaccgcagaaggatggctcccacttctgagttctcctgcaaaagtctacctatttttctgtaccaggcatttggctcttattcagcattgcattttatcatcagttattctttaaatttgtgctgcccaatgaaaggaaggcggatcatttgagttaaggagttcgagaccagcctgtccaacatggtcaaaccccatctgtactaaaaatagaaaaattcgctgggcatgttggcaggtgcctgcagtgtcagcaacttgggaggctgaggcaggagactcacttgaacctgggaggtgggggttgcagtgagccaagatcatgctattgcactccagcctggaggacaagagtgaaactccatctcaaaaagaaaaataaaataaaattttgtaaaatgaatacctttgttgcatcttttactctatgaaaaacagcatattgtaagtggctacgaattttattggtatttcaatgactcccagaagagaccaagacaattttaatgatagggatcatgaaggagaatcgaactctggcattagtttctctgtaatttttagagaaaatatcctcattgcttgaaggctgcaaccagcattatttactggagattcttcaacttccctgcttttttaattgtcccaaatgtaaaatgtctgcattctttgttactaacaaaattgaatttttttttacctttttccattgatctcagctgactgtagcatctgttgctatttttgtgataactgtggatcaatagtttaaaacttataatacccattatgccatgtggtacagtcttacaacacaggaatttaaacattaacagatttccctatgaactgtaaatgttcagcacagaaaggccttttgagagacttaatgtgttagttttcaaaaacttaagcattcccagatttaatcagttttccctttttttcaattgacgtgtaataattatacatatttgtggaatacagagagatattttgaaacataatatgtgtagtgatcaaaccagagtaattaacgggtgcatcacttcaaacatttattatttctctgtgttgggaacattctaaatcctgtcttctaactatttgtaaacgtgtaataagtggttaactacagtcacactgtggtgccatagaacactagaacagattcatcctgtctagctgtaattttgtattctttctaaagacaatctacagctttgtcagaagtttcaaaggatgagaacagaatgcctgggacaaaagtttgaggacaggagtggggattgcattccttacagtatccggcatgcatcagatactttaactgcaaacattgtttaaacttacaattaactctgatctaaataaaatgtaaacttatagaataaatccccactattttgaaattaaacctgtgtcaggtgaaatgtaagaacataactagaaaacagaaaaaagaaagacatagttacaatataacaatatatatctctgaatagatcatgtctaaagtttgaacacacctttttgtgcatacaaatatgcgcattcagcaaggacagagggaagaccatggaggccttacagatttcgagactatgaatgaaatatgaatgccctaataagtaacatttattgatgcctattttagatgaagagaaacatggtgtcacgcgtgtgagcctatctgtatagtgcacccagttgacggaggttgttttattttacgttactctgaatttgtctttgaaattagggttggtgaccacagggtggcaccttccatgtgtctgtgtgcattcagtagaaagacttatctgttatctaagccctgtctaaggcatgtcttctcttggtcccctcagtggtgactgctgccacctgaggatgtttgccatccccgtgacaagagcacagagccctgaaaagggaagggcattcatgtttggcggcaggaccagtatttgcatttctgatcaccaggatcaaaactctaacttaaattatgtattcactgcacatatgagcttcaagtcattttcccccaaaattgaaataaataaaaggtgtgacaaccaccatgcatattttatgagaagaatgtacaattgtagttatttttgccaggccccaatgcctgtatgcattgtacgatgtattgaaatatgcaaaatacacatacaaatatctaagacttctcttccttccactgtgatcgtcgctattttctgttagggctctcttgctttttaagtagcataaaattcactacttcatataatttatttctgtgcttattaaatgtatagatcaaagggcatatatttttattacacatgtctactaaatgtatttagtaaataaaagtgtatgttagagcccacacagtgctaatggaaagagactatagtaatcatttacattagtgtttgaaacttacagacaccagaaagggagacatggccccttttcacttcattagtttgtcactgcattcttctgcaatttattacaagtaatttagttgtttcttttaagaatttcccttgacaattatctacctttagaacacaagcaagtcagagtttgagggaattctcactgggcaaagactaaataaggctgacttaacattaaatgggttatgttttggtagttttaaatactaccatcttggctatttttatttgtctcctttgatttcagacgatttcatgggagcttaaatgaatgtggtcagagaatctttaattaaatatcactgcctcaatttggaagtcagaaacgtgaagacaagaaattgtaattgattttcctggtcagtgtggattgttggggcaaccaaggtagcttaaaaaaagcttagtaactgagagggtgatctctcttgacagtgttttaaatgacataggaggatatatgctactctgtgcaaggagattggtaaaaagaaaccagtaacagtgtaagtaaaaaatgttcaacagagaaatttttcaacagagagcaagatgatggcatttaacaattaatttttctgtaactttaattctaaaataatttgcatttctttatcagtaaaagcattatagaaataaagattgcacaatgaagaatgtgatagagaaaggggggtcacattaggaatgtgaggtttgtggtcagctgtctttgcctcctgaaggaagtcacatcaatttactttagcaagataaacttataggccattactcccaatcggcttatctctagaaagcaaaaaatcaatgataatttctcccgatagtcattgtttgtgattagggtaggaaatgcaatttttattaaactaattgtctctgttcccatctaatttaagattaaaatataatatgggactattgtagttacatgactataatataaatgaacactgactttcaaatccgcttaaagcactttataattggacgtaatcatgtaaccacagtcgtgtgctgaatgtcacctgtgtatcagatcctgggaggaaatgacaggaggtaggggagagggctcagggagaaaccttacccagaatgcttcacacggaatgttctagtaggatgcacacagcaccttctacatgccaggcatggctttcacccattcatatgtagacatacgtaacatcccagcagcctcacaaaacagggcctatttatgccactcccactttgcagatgaggatctgaggcaaaacgacacacctaatgattggtaaaggtgaatttgaagccaggcagtgtgaagcaggtgtgtccttatccccagctccattctgcggaagctgagtcaggccaggtcgcaggtgatggaagacctggggcatgagaaagattcactctgccattgcctggtgttgcaggagccagggcctgggagccatggtgaggcaggtggtagacacactggaaatgatattctactcatgtggtccacaccagtgatcccagcaatttgggaagctgaggagggaggatcacttcagcccaagatttcgagacaagcctggaccacgtagtgagaccacattgctacatttttttttttacattagccatgcatggtggtgatttgcacctgtgtctcagcttcttggaaggctgaggtaggagaatcacctgagcccaggaggtggaggctgcagtgagtcgtgattgccccactgcactctagcctgggtgacacagtgagaccctgtcaaaaacaaaacaaaacaaaacaaaaaaatacacacacacacaaatgttgagtgagaatcaaattgtgttaatacacatagaatatgattagacgcagatgtgatgcgattacagggttttatgagtactgaaaagatttaatgtatgtaaactgcatacaacagtgttggaaacgtagaatttatattattaatctccttcacacctgctttaggtagttctttgtatttctattccctctattttttttaatccaccgcacttattcccactgaaaaccatgtattttacccatttacctgtctactgtttattttctttccctagcaagaaagctttaggaggctgtaatttttgtctgttttatttataactctatgtcatatatttagaaaaattctaggcataaattaggaaatcaatgcatattttcaaaatgaatactgatagaaagtgtaattggccagattagcaaggagcatgtgtggtatctgcagcaacattgtaaaggctagaggtgtggtaggccttgctccaaacgagtttctgttgtccatgaatttaatcctgatagcaagcctctccagagggcagcccatttctcagccgagtgaaccagggcaccaagagattcagacttacctgtggagagagttaaatgagtagtgaagtcagacactgaagcaagtcatgctgactcatattttctaaaggcagaatttgctttttactgtgtaactggacagaatcagtagctaatacacagggaaacatgaatatattgacacagagacttctaaaacattttgcctaatacctgcattttgtagatgcattctggaatcatctaaggattttgtaaattatacagttgctcaacttccaggattaaaagtcttgagtcaatatttgcagaatctggttgtgtgtgtgtgtgtttgtgtgttttgtttgttttttatcttgccatatatgatgtataagccaagttttggatctgtgttgagtaatatcactaaatatccaaatcagacagaaagccattaaggagccaggggcaacttgcccgttaccgtgtgcctgatcaagggaaatatgacttgggaatgtatcagctgaaggaaatgctggtgattgaaaagagttattttgcaaatgtacctgtttcacatcgttgtggtggctggcgtgtgtcctcccatgtccacattcatatcacctattttgttttacaaaaacagcattccctcctcactcctctctttgcacaccacaggggagctattgctctcaaaacaagaacagaggctactctggagggtttggatgaagtaaaagaagagttatgtctctaactggaaacggaaaattgcttcagtacagccctattgtagcatcagcggcattagatgaagtttcatgggagcaaccagaaggaaggtatccccgtcacggggcctcagcacccagttgcagagagcagagagatctgattacagaagaagcagccacattaggagagtttctgtatttcattttacttatttttttgagacaaaatctcactctgtcacccatgctggagtgcagtggcgtagttttggctcactgcgacctccgcctcccaggttcaagcaattctcctgcctcagactcccgagtagttgggattataggtgcccgccaccaggcctagctattttgggtatttttagtagagacagggtttcaccaagttggttaggttggtcttgaactcctgacgtcaagggatccacccacctcagcctctcaaagtgctgggattacaggcgtgagccatcgcacctggcagagtttctgtattttaaattgagcagtgttcccaatgcttccaggcagaagcaaatccatttttctacgatgctgtcgaacagccctcatcagtctcttggctatcagtaataaataagatgcagcagaccccgcctggaagcactagggagacactgggagatgaaacatggaatggtgctgagtaggaagccgaaggctcccattctcatcgtgaaatgcaggcttccaattccatgcatcagctcaatgttttaagtagtatattggtaatggtagtatccttaaataattaaatatctttattaagtattaatttagcacattggaactcaaggataagaagttcacttaaaaattctttgtatttttaaacagcttgcatttcttcctgagtttattcactgccatatacacactcacacccttgcacacgtacagacatcccccccttatccttgaaggataagtttcaggaccccagtggatggccgaaactgtggctaacaccaaaccctacataaactatgcttttctcgtactttgtacccatgataaagtttaatttataaacggggcacatatgagataaacaataactaataataaagtaaaaacagttctaacagtatgcaagtatccacccgcttgccatcattaagtacaagtaaaataagggttacttgaacacagacaccacaaccccatgggcgtccatccagtccctgagatgggcactgagtgactcccaactccaggcaggcggtgcaaacagcagggaccttctggacagaggaatgattcgggaccgaggcaggatgcagcagggcggtgcagggtttcatcacactcgaagaatggcccgcaacttacaacttaagagttgtttttttctgaaatttttcgttgaatattttcagaacgcggttgaccgtgggtaactgaaaccgttgaaagcaaaacattgaataagtgaagattagtgcatacatacaccaaatcaaaagtacattcttacaggtttctatcatctaatccagataatatatattatattttatatatatattatatatataatatatatgtctgtgtatatatatttgtacatatatgtatgtgtatatatattcatatgtatatttatgcatatataaatatgtgtatgtgtatatatattaatatgtgtaatatatgtatgtgtatgtatgagagagagagagtgtgtgtgtgtgtgtgtgtgtgtgtgtgtgtgtgtgtatttatggcctcctggtactgagtctaattcctaacttctttcactttatcttttccactttagcctctgttggtaaagtttgtgtcacttttataaaaccaatcagcagcatttacttcggctgacatattcccaagtcagatttcccttgatcagggcacacgtatctttaggtaggtaggtaggtaggttggtagataggtaggtaggtaagtagatagatagataatggatagataaatagttgtatgatagatgatagatagatagatgatagatggatggatagatagatagatctcttttaaaacagatttcaaaatagtcttgaatcactcgataaatacctgagatgaggccaggtgaaacggaatcactcagtgggatggacgtttcagcttagtaattaagcattgagtttatcaggtgttactcttgaaggttcagttcatctggggcattttttacttttctttttttctgtcttaaaaaaaatcaatttaggattgaactctgttcaaacaagcaaacaaaccaaaaaggtcttaaaggcaagggttgctgaaatgcagctttcatggtgcgttgcctgggcataaagtcagggtgtttagtagaatgtactaagaaattatacagagtctcagcaaatattttcctcttatagctattgagcttatggttctttttgttttttgtagttaaattactattcctaaggaatgagtccttccagtatgacttggttcattattaatttcattgaagggtacagctagaaaaagtccttgacaataaaatttcattggtttactatggtgaggctgtgatccacacaggttaaatgacttgatcaaaattatttttagcggaaagattttaagcctttctaaagagggcagctttgtatcgagtaattgccctgcagggtggcctcgggcgaaactgctaaattgatagagtcctctcggaaagactctgttcccaaggcaaccaccacgagtgacctgaactcagggcttgcccgtggcttccgctaggagccctctcctccaaggccctcctttccctggtggcatccattttattaggctctttggtcataggaatggagcattttttttgtctaaaaaatgtggagagcatgcattctgctcttcttacaatgttgctgctgttctttaaatatctgctgagttcagtgagagcccagggtttggagtccattgtatggtttcaaacctcaggtccaaaaccactaaggtcacattattcaactgctctaagctttagtttcctcatttataaagcagtgataatgatggaaactcactcatgggtggtgaggagtaaatgaaacatcacatgtccaaaacataagcacttaatgctgttaccattaatattggtattgctcatcatcttagtctctctacctgtaaattctgtgctctaagcctctgacccatttatactttgtttcctcaattgttgctgacctcccagtaccgagcataattcctatcttctttcagtgcatcctttccattttagccttggttggtaaagttcatatcactttcaaaaacctattttagattcttcacgggtggaatcaaatcaccccagccatactggctgcactgggtcaagcacttatccatgaattgtccaacagtggctgggcaagtttcggattgaattgaaggggttaaaactggtagtcattatcatgaccatgccaggtaaagaatcccacactcttaccaagacaagcaacatttctccctgtattagcctgaacttccactaaaatgaaatattcctccatctctttctttcaagagaggcattcagagagactctgtttgtggagatgcatctgtatctccataaatgctggtcaatgtagaatgcacgtcattgtttgctgggggaaggaggacagtgggaaggtggagaaactgcttaatgggtaagaggttttactttggaatgatggaagtgttaacagacatactgaaatatttatggatatatagatttatgttctggggtgtgctcgacaataaacttgattgggaagaaagtgtataaggacgtaggaaaaatagctgtgataattattacagctgagtgatgggtatctgtaggttcaattcacttttatctgtaattttgtgtatgtttgaaataaattttccccactaaaataatttttacaaaagcaacctttggcaagaaatggcactttgaagcagcaaattggtctacgtattatagtggctaaaagcactctctcttatcacctctagcataatttcctaatatctggcataacatgaatggggttgtttttgaacatgtcaaaatattaggttaagggtatcacctctgagtgacacataactctggtcctatctgcatagaactgtgaataagtttctaggtctgtttaatggaataaacaaggtgccttttggtgaggttagtaaatgctggtgaaggtcaatctgtcagaagaaatgtaagctttttagaggatgacataagtgagaggtgcacatgtaggcactgaaaccatatagtgtgtgcaaagctgttcattggcggtagcactttcctctcctcgctgtgatccctaccactaacctggggccaaatcagcatcagtcaattaagggataatggatctcttgagagccttcttagacagcagtctttgctctgctaacctagaggtttgctctatcccagctcagtggtgatcagacacagggcaaaaaaaaaaaaaaaatcgctccttaaatttttttgggagcatgaggagaatgcatcagtgtgttcatttatctacatgaaggaatggctgagtcagggatgatgcatccaaggggctccatgtgctcaaggtattttctcatctcgaatttaaccatatggggaatcaaactggaagcctcattctctgcctacctgttggagacatgattttgggggaatggaaggacttgaagccttcaggatgatcacattgtctccttgtaagtagtttacttttgcaaacgggaaagttcttttggggtgagagcagaatcacagccttaaggtagaggacctgtggaaacacttgcagcgcttcgaccaaagatttttctcctctgaactttttgaaacattattatgtatccgttcttctgtttttgtttttttttttttttttttttttttttttttttttttttactttgaattggcaaataataattctgtagatttggggagtacagtgtgatgttttgatacgtgcttcaatacatggaatatgcaaggtgccttgtttataaatatgctgtagaatgaagaaatcatggtcatcaggatatctatcacctgaaataattatgtctttgtggtgagagcttttaaaatcctctgagctttggtggaagtgatagggacttagcagaagaagaggcgagtttcatctttaaacacttcgctggtagcccccatcgcttcctctaagttgagttcaccgtctttccacactaagatctgctaatggcttccagcaggttgtcatgaagtcttactgacccgataccttctggacattgtcaaggcccacttcgattcctcttgggcaggttccacagtctgtcttgctggggatacatattgcctctatgttcaagcacttgaaatgtatttcatctactggcggatattatatccctcttttaacatgcagagagttgtgcctaagaactgactgagcacaactgagcccaaggcgagtgagtggtggcagagctagactggcaaagtctcactccgaagcccaccctcagacagcatctgccctgcacgagccctgtgccaggaggtgaacacttcctgtagcaagccgtcagtcattaaaaaggcagggaagagtgtgcctgacctgaggtctttttaagacggcattgcttattgcgtggcagtaagtcttgtcatgaacgagttagttaaatgttccacaagtgagttttctgaaagttgtctactttagctcgaaacctttacttccctggctgacatgttcagatcacgtggagaattacggccagactttggattagaagttttgctggtcggtttggcggggctccccacagaggacagtagcatcacactctaccacctcagccctgcagatattcgaacggcactcatttgcattattttgggattattgatttaaaatgcagtcggtgatagattgaaaaccacgtggatgccagtatccctgccttagtccatgaatctgcttcagtaaaagaactaatgttagaaatattaagggggcattatcagtcaatgtgctgaataaacctcatatttgacatttgagatgtattaatagttcagctccataacttaagacagaccatgcccaccattttaacttgcatcatttgcaagattacaagagcactctttctactttctccttctgttccatctgtgctccccacacgactgctccaggatggtggtctctaccacagatgccctttttctttggttaatgtgcaagtcagtcacaccactgaaaggctcttggaacataggcaaacctacgtttatatttattttgaaagaaaagtgctaagttttattattttacttattatttgctactctgttacgataaacctaacacagaatttaccatcttcacaacgtttagatgttgtattagtctgttttcatgctgctgataaagacatacccaatactgggtaattgataaaggaacgaggtttaatggactcccagttccacgtggctgggaggcctcacagtcatggtggaagatgaaggaagagcaaagggatgtcttacatggtggcggcaaagagagaataagaaccaagagaaaggggtttccctttgtaaaaccatcagatcacatgagacttattcactaccatgagaacagtatgggggcaacagcacccatgattcatttatctcccactgggtccctcccatcgcacgtgggaattatgggagctacaattcaagatgagatttgggtgcggacactgtcatagccaaaccctttcaaatgtacaattcaggggcattgaatacagtcacactgttgtgtagcctccaccaccatgcatttccaaaactgaaagtctgcacccattaaactctcattacccataccccctcctccctgccgctctttgaatttgactactctaagtatctaattatcgatgaaatcatacagtatttgtccttttgtgacaggcatatttcacctggcgcactgccctaaagctcacccatctgtggcatgtacctgcgtttccttcctttttaagactaaattataaccgattatatggtcagatcacattatctttatccattcatgtgtttatggacagtctttctgcccctccttggttattgtaaataatgctgttttaaacttgagtgtaaaaacatctacttgaatcccagctttccattatttcaggtgtgtacgcaaaagtcgaattgcagtatcatatgctcatttttattagtattttttcgaggaacttccatactgttttttcacgacagctgcctcattttacattcacaccagcagtgcatgagagctctagcttcttactctttattcatttttaatgcacacattggtcaccctcatgttagaatattagacaggaaaagcccatctgagctgaggtatccacttggtacctgggcggggctgccagctctctggcaccctctgtaggtatatttatgggaactgcagtgccaccgttcaggcgggaggctctgcagatgagctgactgcctcaaaggtatgtgtatgtagaattactttccagaggttagttttcctcttgtgataattgtcaaacgcaactttgaaaataaacacaatttaaaattaaacattcacattgctctaagtatggttttaaaatgaaacactttttaaccatgtttaatatcataaataattggtattatgggatagtagtaagttgggtaacattaaatgccattatctttatatagagagaaaaaaggatagctaccattagtaactaagagaaaataaatgcaaatattgagggtttgtgttcacagtgtttactggtggtatgtatattcataaatgtaattcttcagagtttagtcattaattgttaggttatctgtgtatgatgctaaacagatatttcctcatgttttttaacgggacaggaaatctatctttgggcagggagacattgctttacagtgactcaaactgattattaaaacattagatatttgcacaactcatttccatcagagggcatgctaagaataaggctcaggaatgagaactggactggcaagttccctctggtattcaagggcccataggtaaatatacacctcgtaccactcacaaaccagaactacagactgatgtcacctgtatgatggaacataaaaaaggattgatgtacctaccctcgtaacacagggaacttcacatgaatatccagatttcctgcttctcctgaaaacatgaagattcaaaaacactggacccaaactatgcaagagaataaaggtgttcagagttggcctctcatctctggtttaaagcatcccatctggctctacacattcaatacctgctgacccctgtccttgtcaccaatctcattccatcctttctaattatagagacttatattatagcctgaaagatggtggtggattagttctattgctacaaataaattaccggaattattattggcctaatgaagaaaggtgtctgagctcacgtattttttaagggagacgatgtgcagcctagctgggctgttctttcccagcctctcatgggtttacagtcaatgctggctggggctgcaggcaacggaggctgagttccaagagctgattcgtgtggagattggcaggacgcctcggtgcctgcatggctgttggcagggacctcaggtcccttactaggtggcattcccggtggctgcttgagtaccctcatggcatggctgttgatttcctgagagctgcataattcttcaagagagaaagagccagcaggaacttgcagtgacccggtctccgtagtcacacacaattacttccactgttttttctgttcattgcttgcgagtcattaggtccaggccactatcaaagaaagaaggagtaggctccatcttttcaagggcatgtttaataatggtagatgtatttttatccactgcaagtggaatacatgggttgagatactgagtcacagtccttgaaagattcctagatcaatggttttcacgtgttcccaagtccttccactctgccctcactaacaacacagcagttggtatgtggccctctgcctactctctcattgcagtggtggctgcccctgccacatctgagaccgggtcctccactgctcactccatcctgttgcttggacatcactccttccctgaaaccttctctctcctaagccatcaggcttcctctctcctcaactgtttctacttaatacaagcagctcatgggagggacacaaacccacatacacatacacacacacatacacattcatatcacccacaaaatcagcaccggtatttctcctttggccccacagtcgccttcagctttggtcccaaatctctgcttccttttaaaaaataaaaatgttcaagtgatgtctatcctggtcatccaggttctttgtcattgtttccctgtccatgcagggatatgtttgtcctgccctatgactgaaatagcacttgtccaggtcttcatggccctggacctgccaaactcattggttacctctcaacccacaccttgagggccttcctagcaacactaatctcttttcactttcatttccttgaacctacctccttgccttcagggcacagctccctcctttagtccctttcctatctatctgctgtgtctacctcctttgctgaaaactcaccttccaaaccgctatgctgagggcccttaacctcctgcctcactcctctagtcgtctggagaggttaatgggcctcttcccagaataacgtttatagctgtataaaatattaggataccaaacaaagctagttgcgttgaaatagtcatcaacatattttaaaaagaatttgtacatagtggggcatgtgcttctttaccatggcagatctaatagcgacaatagtctgaattttaaagtaaagcttctgatatctgccatcaccgttaatgtgataagaaaatacctacagtttctgctgatggcaaagtactgctggtattcttatggctttttgcttacactcataacagaagaaaatactaattttcacttagaaggcagtgtaaataaaaatgcatttcttttcctatttaatttcatggactccctgaattctcatggttgagcccagggtaaatgtccttcctgcatactgggagtgacccagaggccaattctcattccccctccctaattcctctcccagcccagaggaagggtgctcagatcattcagccttaggacccttttgaaaatggttgaaaatcccaaacagcttcattttttaaaggttatatagctaccaatacttaatatattcagaattacattgagagaaaattttaaatgtttatcacttcatttaaaagtgacaatactcctttagaaattaacatatatatttatgaaaataagtatatttgaccaaacaaaaacccgggatagcattgggagatatacctaatgctagatgacgagttagtgggtgcggcacaccagcatggcacatgtatacatatgtaactaacctgcacaatgtgcacatgtaccctaaaacttaaagtataataataaaaaaaaaaaagtagtaaaagaggtagcattgttttctatttttgcaaaactttttaacgtctggcatggtgaaagaggctggtttctcatatctgctttcgtatttaatgtgctgtgctctgttattctggttgaagtcaatgaacaaaatctgtgtttacacagatagaaagttgaaaaagagaggcgtattttaatatccctcttagataatagtggacatttttctttcacacaacattaaacttaacaaatggctatttcttaaaagttagctacaaaatggaatctgcatccatataagtcaactttttgcactttattatagtaaaacgtgttggtctattttgcattttgaatgaaatttttactcatccgtgatttggtagcagtaagttgcggtcattttgaaatcatgggttcactttatgcatctctttcaaatgttagtgtctgtatctaaaaataagttagatattgtgcaataagtaaaaaagcacacgtgttaatatcaccctgctcttaccaaaaaaagtctttaagttttgggaagttacaaagacagacactacttgtctaaaattctaatattttcttgaaaacccgaatttcatcattggcaaaaagactatctaataattgtttaggtaacaatagctgactgttcatttttaagtaaatatgactaaatgcccaactatgattttcggaatatctgaagagaatacacaggatcctaaggtagtttcccatgatctatgctcttggataatgcaccctccttgagtgaatatgatgtgttctctgtcctatgattagcttatggctcaattgactttaagaaagggagatggtgctcagcggccctgacctaatcaaatgagcccttaaaagggactttttcctgagaagaggttttgagtgtgaggaggattcgaattgggacagtccccgttgcattgttgatggatgggtcacaaggcagggaagggtccatggccacaagcttccctgagtgccccgagtggccccttcattagccagcaagaagatgggaacctcagtcctagaaccaccgaattggacttcaccaataacctgactgaatgtcaaaaaggattcttccttaggactctaagagaagaaagcagctgcgctagttccttgagtgttagacccagctcagagggcccagctgagcttcacctgcagaattgggaaatgataaaatgctgctttaagctcttaagttggtagtaatttatgtggcaagaaaaactggcacacacacaatagtttgctagtctctcaagtaaaaatggtgttccatgaaaaagcagctagttcatccctgaaatcggggaatctcaaacatatttttcctcaagaccagcatcgttccttgttacacagcagaagtgcaggtgcattctgctaacgactagcattaatgctaatattagaaaacctaacgacaagagttttcgcttgtaatctagaatccagaaaaattgatcctagggcaatttaccgaactctgtgcggaatatacacatttcatgcctggaccaaacagttttactaatggggacttttcccaccagggtccttttaaggtgagttattaatggcagtattttggagacattgacaagaggtaagaagggttatagatcagagaaaaactcaaaggtaagacagaccctgcttttcaggagagaatggtttcagatctgtctgaggttggggcaagcactttttaatatttatttaagattaggagtttaattatatgttgatttcttagctactgtgctttcaaattcctaaagtgaccctcaacttcgtcttagattttatgaaagctcaagctattatatctatttatttatttatttgagatggagtctcactctgtcgcccaggctggagtgcagtggtgtgatctcgactcactgcaatctctgcctccctggtcaagcaattctcctgcctcagcctcccgagtaggtgggcctgcaggtgccagccaccatgcccagctaatttttgcattcttagtctcaaattcctgacctcaagtgatccacctgcctcggcctcccaaagtgctgagattacaggcatgagccactttgcccggcctcttccttatgcttctgacacatctctacttgtacaacctgtgccaactccacccatgtgtactggcttgtggggggcttggggacagcaggaggtgagggatgaggacggccttgggtgcacctgtggcatgtagatgcatcagtacttcccattgtggacagtcagctacttaacgggcacttcattctctgctattttcttcatacagcgcctctcagaaaactccctgtaattaatttctcaaaaaatggcttatgatgaagattgaccattcagagagaaattctattatcctcatgtaaagaatttagaattctgttcctttatttttcaccccattaactttcatttaacatgttatttaatgaaattaaagaagctcttccaaaaccatgaggaggaaaacagcaaaataaaggtatttgcaaaataagaataattaaggtaggactgagaaaggagaaaataagtttgaacctgaaataccactggaatttaataatttaaaaatcctaagaatatgtttctctttgtgccatgctctagaatgctgtaagttaccttgctatcttagtgaccgatgttaaactaatggactcagtcccatatgtgccagctaactgtttgatgttttctgaggaatcagaaacatgggactgatcctaaaaacctgggctagagacgttgatgattcactttcatctgccgtcactagtaaaaatccacagccacacacactcacttacacacccgaatatgtggccactcatctcagatccttgaggggcattgctgcttataaaaggaaaaaaaatgattggatttaggagtttcacaaataaaattgcattcctttgaaaatcacgcagaggctggagaaaaaaaaatggtgtttcaggaccacctgatcttcccattatgcaaaagtcgcaactggccgggcatggtggctcacacctgtaatcccagcactttgggaggccgaggcgggcagatcacccaaggtcgggagtttgagaccagcgtgactaacatggtgaaaccccgtctgtactaaaaatacaaaaaaaataaattagccgggtgtagtggtgggtgcctgtaatcccagctagttgggaggctgaggcaggagaaacacttgaacccgggaagcggaggttgcatgcagtgagccgagatcacgccattgcacttcaacctgggcaacagagcgagactctcgaaaaaaaaagtctcaaacgttagatgttcacatctcctgaagctgttttggatcgtgtcagcatctgaaggtgttacagctttgctctgtaaaatgaatctcccagggcttagagtacatgcctggaactaggtatcatttaagcttcccatgggtcatgaaggagaaatgtgctggtgtgtgtgtgtgtgtgtgtgtgtgtgtgtgtgtgtaagaataaagactttgaccaccaatgctgtgaggtttctcctactgtgaagtgtcacccctgtttaagaaggttagcccccagtgttgagacaacaaaaggtctatggcagcagaaaggaagtggttattgttgaatgtgttgttcacagatctgaaaggacacatgtattctgttgaagtgcttaaaggaaatagtttacagtgaggttgttgtgcctggacagcttttattattcccatagatagaaaaggcagaagcagtatcaggagttgccaaagtcactttccagtagcttctcctctctctcccctttcttttttcttctgtaagctctattgattgattaaatggtaagatgtgccaatttctccattggaagtgaagatgacgtggcatgtttccaactccatggacgtcttacttggggagtggagaggttcatccccagcttcctgtgtgcggtgaagtttaacgggaaaagctgaataaagagttgcattaacattccacgttgaatgtaacaaagacttggaaagttcttcattttctgagaagtattttccatgcactttgtgtaaccacacaggctagacattgcactaggtgcttctatttgccatgtcatgtaatcttcaccacagctctgagggtcaggtggtgatcatctttattaaacacacgaggaatctgcgatttagaggcatttttaacctggcaaggtgacatctctaatgagttccagaacaatgattaagtctttcttacaactaacttcaaaatccccactgtgagggagatttttcctgttaaagatccaaaagctggacacacgtagaactggaaatgccttccacacaggaggaatggaaagcagccagtatatatttgtacataatatgtggctggtatgggggctacagtgtgttctatgtgaatgacacccctggacttccccaagctcatctgaccgccctacccagagtgcactttcctctgtgcatagagcatctttttcgttcatcacagcactcttgcaagagatgtattattgctcttacatgtcaaaagaagtcactgaagttaattttcccaaagtcttcattgtaatgaatggtccagggaaaatgggaactttgttctgagttaaataccacccacttttcttgagattctgcattatgtgcctggaaaaagaatgagaaactagacttttagggtagttaattcaagcccttcttttaacagatgaaaaaatccgaggctgtggctcaggatttcagaacatttcaggggtgagattggagctcagctatctgggcctctagggcagtggcctttttgctgaaactggggtttttgtaaaaacgttgttcaccttgcaaggtgaacaccttggaaggcttttgataatcccagtaggaaatttgggaaattatagtggcaaagactttaatgcaacgaagtatagaaaagaagaacgagttaatagaacaggacacaaaatctttcttggaatttgcgaatcgtctgagacacctctgttttccacctcaggagggttttctacatctcaatacgtagagtgcaggaagaatgttgtttctgagcgcgttgtctcaccccttgttctgcctccccctttgcgctttcttatcttctcgctccttctattctccctctgtttggagggaaaaggtttaaattggctccggtggtgtaaaccgatagatcactacaagactaagtaaaacaatctttaaattccacctgcttccaagttaaatcctgcttatgtctgaaaacttaaatcacagggaaatacgtgatttaaatggggtccctgatttggtaaggaaacgtgagatgaatagttaattgcctttcttccagtaaagcatcttatgctaattaccctttacattagtaaagagttcagtcatcaaggttttgtggacattctcacgctaatcctccatactaccttgacacaatgattcatgtaatactataacttcatatatgagacatttatcttttaatttagtgctgctattaagcgacattaaattaaaagattctgataaccaatcaggaatatcaacagtacaaatggttcacattgtaagtaagtacctctgtctttcctggtgcaaaagatgacttataacatcaggctttcagaggatgattttcctgaccaaggaaaggacactgactgatttaagggtagaaataaaatttgataatgtagttcttaaaacttggttgtcagtttttctcaaaagtccctattcaaggacatcaaaaatccaataaaaaaaatgcaggaatgcctgaatatttgtaagctgacaatgggagctgcagtcaaaataaccttgtgaagacaacaactgtttccagactttaaaaaaagaaagagttattgtactaacaactcgcttctcgtaatgtacagaccatgagacaataatagatttatcccaaagaatgatccaatagcgcattattttaaatgttaataaaaataagatagcatttttcaaccaccaaattactgaacattttcttttatgtactaaaacaatgtgggcagagaggctttagttaagatattcttatttacatcaggtgaagtaaactggtcctatagttctagaaatcagtttagcctagtagattaacagccttgactaaagaattctagttctagcaaattattcttggaaactgagcagaatttgataggtgattggtgtaatgtacaattgtagtaagtgagaaaaactaatttctaatgataaaggaattaaatacattatgaataatctattaaaaataccttaggaaaactgttcaaagaggtcataaaggcagaataataaatattaacaactttatttttattctaccaatattaagtgtcttcacctatcaacttatatatacaatgcacatagcattaataataaatacataaacgttctaacagtggttgtctgtggtgatgggtttacacagttacattttcttcttgattatttaaaaattttctcaaatattctgcaataacctgtgaacctaatctttcatggccatgtgacaaggaccctgtttttagctgaactaaggggaacgtcctacaacaatatcttcatgaatatttcacagttacaataaatgataaaaaaagcatttcatggaaaagaaaaacaaaattaatactgtgtgactcagtgtatatcttttattatagtgggactaatattaatagatgtttaatcatatttaaacaactgacatacaagttcattaaaatacttctgagataagcgttgaaagagttgattaatcaaaatctgaatttaaaaaatgtagcataatggaaaggtacgtttactaatataattttgaaatgtaataattatcaatgaaaaaatgtaataattatcgacgaaaataaaaattttaagtgtaaggtgtggttaaagtcagggctataatttctgaagcagactgttgagatatggtaaagccagcaggttctagtatcagacttcaccacagcaaaccctgcttctaccatttcaagctttgtgacctttattttttaagttctttgtacctcaattttttatttttttgtaaatgattgtaggagtagcataaatcttataacattttggtggaattaaataggatgtactccagcattttagtaccatgtacaaaatattttttaaaactattactcttgataattccgatgatgataatgttttattagatgactaccatacttccatcggataagtgaccaacagagttaaatggaaagttgaaccatattgtcaagaggcgtttgaaccagagcaactccatcttgaataggggctggagaaagtaaggctgaggcctgctgggctgcattcccaggaggttaaggaactcttagtcacaggatgagagaggaggttagcacaagacacaggccataaagtccttcctgatgaaataggttgcagtaaagaagccggcgcaaatctcccgaaaccaagacggggacgagagtgactctggccatcctcactgctgcactcacatcagcaccatgacagtttacagtttacgaatgcagcatcacaaagttactctatatggtctaaaaaagggaggcatgaataatccaccccttgtttagcatatcatcaagaaataaccataaaaatgggcaaccagcggccttcaagactgttctgtctatggagtagcccttcttttattcctctattttctcaataaacttgctttcactttagtctgtggactcccactgaattctgttttgcatgagattcaagaacactctcttggggtctggatcaggaccactttccagccacagtatggcaataaatagtaaagtgccataggcaacacccatccctgtgaacaaggagcggccagtgaattagaaggaacccaaacagggtggagttctggaagcaaagggcagaaagtgctttcaggaggaagtggctgattgtttcagagtgaacaggagggtggacattcgaccaaaatatttagcaacagagaaattacagctgatgagatttaagagagaatgggaagagatgcaaagagaaccgttcatctgaggggtttcctccatcatgtccacagggagtaggggctgcagcagctgcagaggaatgtggagggaaagattcctgtctgtctgcaggccgtgtgccttttaaaaagctgtttgcaggccgggcgctgtggctcatgcctgcaatcccagcactttgggaggccagggcgggaggatcacatgaggtcgggagtttgagaccagtttggccaacatggtgaaaccgtgtctctactaaaaatacaaaaaataggtgggtttggtggcaggtgcctgtaatcccggctactcaggaggccaaggcaggagaatcacttgaacccgggaggtggaggttgcagtgagtccagattgtgtcactgcactccagcgtggatgacagagtgagactctgtctcaaaaagctaaaactaaataaaaaaggttgcttgctttgtcttagtttgtaaagatgggaaatggaacaacacatttttataattgggttaatcatgcagaaaagaaaaaatgatcatgcagaagaggagaaaaatgacggaaccacattttcaaggtgatgagctttagggcagacctggaggctcaggttttagactgtgaaatggttccatccttcaggaaaacaaccacagtagagacatagctcctactgatgtttacagtgtatcagcacaaatcacacgttaacaataattagcagagaataggaaattggctcaacgcttacttagaaatttaatgggtcttagggtgtttaactatacaggtactttgatgaataatttgcaaaaaataattaaatgtgtgtttaaaatataaggtgatctgaatttcgatgactcttcctcagtgtaaaacacaaaaaaatctaatgaagaaatgttaaaatttggaggggaaggggattatgtaattgtgtctattaatgaataagttaaacattttgaaagcaattctaaattctaatattagaaaataatttattatagtgtaaatgctcctagaaaaagagagtcctagagtaaaagcgaaacaatgtaaaccattgagatttctccaggtgtgttgtgttcaaaacatgtttcacttaaaaaattgataaagctctgagataattcaagaacagtttaatttttatcttgcaatcataaactagacaaaaaatgctccaaataaccaataagccattaaaaaaattcttgtgttgttgtttttttgagaaactaaagggtctcactgtgtggcccaggctggagtacagtggcaccgtttcggctcactgcaaactctgcctccggggttcaagcaattctagttcctcagcctcccaactagctgggactacagtcgcccgccaccatgcctggctggggctaattttttttttttttttttttgggatagagatggggtttcgccatgttggccaggctgctgttgaactcctaacttcatgtgatcccctgtctcagcctcccaaagtgctgggattacagatgtgaaccaccatgcctggtcaaaaaagtctaaatacactgttttcccaaatgtaagttaatatatatgatggaattggaaattccatttgctgtgatactataaaaagaaaaggtaaatataaaagattagtagcttatggaatgtgattacttctcaaatttaacagaaatctattgattaaataattgtaagacaaattaaattagagaacaatagtatgtctgacattgggagcttaatagattcatttatatgttatatatggagcttattatatacatatataatatgtaatatgttattaactttctaaatacgtataaacttatatgttatatacttatattttatacatttatatatatacatgattatatacatatgtgtgtatgtggacatctatctatctatctatctatctatctatctatctgcatagtgagcccttgcaattctaaggatttacaaagatttcaatattattgctaccaatagtagtaaatattcttttggtgcagtacttaaataaaactttttgcctggaagaggcattgataaaattacagtaaacatgcaagttaatgaaaagttgaagacacaagatttatatttttcacccatttctcccaaactctgaattcttcaaatttgcaagtagttggtctctatacacaaaacaatttcctctgtgatttgtgaggatttgcaatggcatctcctcatattgagtacgttacatttgtttgaaagaattttgcattttatttatttgtttggggttatctgatctccctttataggtaaagcttctttcagacagtgagtcatattatctaatgaaggacggtacgggtgtattaagagcagaagatacgacttggtttcctaagagaggtcttggaagttcagtggatcttgaggaaggcagatgtctggctgtgggggctggggcagagggattacagggagggacaggggagcaggctgagctttcccaggggctacagaggagggcaggacgctccagctagagagggcagagaaagaagtggcatcaagtagcaatagttgtattcacttcttacattattgccattttaaaaacagtaataagaatccactgccattcaaatatagtaatggtttcgtcacattttcaaacaacctacagaaagtgagttttaacctaaccacttagagattatagtgaaggcagctgatgtaggagaaaaaaggaaaactaaagtaaatgacacaacaaaattaatgtatcccttaggtatatttattgtggtggtttttgatttttcagcccttaaactaaaaatatttcccccataatttatcttcctaaatgttgttatcagaaaagagattcgtcatatttatttcaagtttttgtttgttgcttttggggaattttttttttaacctcacatacttcttggtttgcgatgagaaaacctaaagtcaactctcagcacctttgaagcacacaatacattgttattaactacagtcacaatgatgtatcagggatctcttgaacttattccttctgtcaaactgaaattgtccatcttttgaccagcatctccccaggtcccccagccctggcctctgtagaccacaatgtatttgaaattgttgaatctgaattactaaggaatcaccttacccaacagacaccagggaatgtgagactaactttggcgtgcattgaagttatcttccacacaataaaacaaaacagaaactcatatgaaaactagataactggactaacaaagctaaaccaagctcacctccgaagattgtgacttagcaggtctgagattagacacaaaagctatgttttgtcatcaatcacgaaatatttttatcattcattcgaagatctgagaatgaatgactcaatagtttaattcaggagaaagaagaggctattgcagggatttgccataggtgacttacctttctcctgcattcctgcagctctagtttctctctctctctgtctgtctgtctgtctgtctgtctgtctgtctgtctgtctgtctctctctctctctctctctctctcctgtttctttgcaaatgaaaatctctgctcagctctgagggcagttggagggaggaagaggcgagggaagggtgtggaaggaagaaaagaggagaacccaaaaaacgtgtggggagaagtgtccagacaccgggtggaccctggacccacaagtcaccttccctttttgtacaacgttgccaagattagcagagctgtccaataagagaacgtagtaacttgaaacaaattacaactcaggagagcagatagtctacatcagtataacactgtcttgttgaaaaataataaataaatacatatattccctagtggagacgtagctttacagagcatcaaacacttgtttgcaagagtacgaaatttattagctcatccagctttcagataggtcctgtctattcgcataccttgatcgtccctgagagactactcgaattttctgtttagattctgagtaaacagatctctgtttgtcttatctgtttagggtgagtgacatttgcgttgagttctatgctctttattatttcccattgattttcttatttgttatttattgtgcattcatctcctctctcctgagtaacttcaagataaagttatttcagcacaagatagtgggggtgatacgtttgccattttggatgaaagcattatcctggggagagctggcagaggacttctgagtgtgccaccaggagaaccgcagaagtggaagcagataccccatctcgtgttccctttcctgtgatatttgtcaccacaacacagagatgaggatgagaaaacacacacatgaagaggcagaagagaagaggaggaagacgccaggtgccgtggttgcaccagagcaagtccctctctgagagttccgtagtgcaggacgttcatgaaccagcgccctttggttggggttggacctgggctggacgttgtgagcctgggataggtgactgtctgtctctgggctttctctgaaacgggctgaagatgaacagccaccctctggccagcccttccttggagggggatctgggtggcccacctcctcgtcttccacaagagtcaatgccaggatccctgtggtctattcatggctctgatgacaacagttttttccagccatgtaaccacattggacttatttcttcattgctaagctacactgttgggaaaagctcctcaaagtttgtatgttccttccagtctctcgtttctccctcttacccttttaaaatacccaggagaagtgctgtcttttggggaaaatattgctataggaaatatagcaaacatttgctataggaaaatatctcagacttggcagtttagacataatatgtgtttctcaccgctcttgatactgggaagtccaaggtcaaggcatgatacagaagcacagctggcggcattgcttcgggatctcaccctcctccttccaggtggaccagctcctgcagccctgccctcctgtctccatgctccccagccagtagcccacgtggaaaggtttggagtttggggctggaagatttcagttcaaattctgcatagtcttccctgtgcatctgtgagccttgcttcctgatatgagctggcggtgtcataattcctatctcagatggcttttggaaggttggaggatgcctcctgaagtgaaaaatactgcacagtgtcgctgcaaagaggctaacacatggtttcagggactctgaggggtagagtccaagaggcatggtctccaggtgtgtcagaatacacaggggccaagcacaggaagaccagagaggaagcaggtgcttagtgacatcagtgagggaagacagtcccaaagggcaattgtccacctaagcccagccctctgaatgtcagtgatttgaaaagagtaacaatcactgccacacacagtcggttactgagttggctgggctcaggacaccatactaaagatggtgcattgatcgtctccagccttacacagtcttggcatcctggcattgtatttcgtcagagttctccagagaaacaaagccagttggtcgtgggtatgtgtgtgtgcctgagtgtgtatagatagatttatttatacagttaacccttgagcagcataggtttaaactgcatggatccacttatttttagactctgttcaatgaatgtatagaagcattttttggaaatttgcgacaattaaaaacaaaaaacttgcagacaactcttatagcctaaaaatatcaggaaaaaaatccaaaaaggtgtgtcatgaatgcgtaaaatatatgtagatatgagtctatatgttaagtaactgtttatgttattggtaaggcatctggtcaagagtgggctattttcatttaggtttttgggggagccaaaagatataatcaggttttcagctgtgtgtgggggttgggggttggtcagtgccccaaccccttgtatgcttcaggggtctcctgtatatacttcatatctatatgaatctccttatgtgcatgtgtacacacacacacacacacgtacacacacagatttactataaggaactgactcacatgattatgaagctgacaagaccgaagacctgaaaggggtaagtcagcaagttggagaccaggaaagccggtgttttagctccagtcagaaagcagaaagcagggaaaaaaaaaaaaaaaaaaaaaaaaaaaaacatgctgctgcaatttaaagcccatcaggcaggaggaagtcttgcctctactggggcagatcagccttttgttctatttgggccttcatctgactggaccaggcccacccacactggggagagccatcttctttcctgagtcagctgattcaaatgttaatatcatccatgacattctcacagacacccccagaatctcctctggcccaatgtctgagcaccttgtggtgcagtcaggttcacacataaaactaaccctcacagctatttacacatagagtcacaggctcagaggcaagtaacttacctaggtcatggggccaccctgttgtaagcaaagatttggagccgatctgcctgctcgcagctgctgtaggtccagtctcatatggggacctcagaaatgtttccactgggcacttagtaaagccaagtgtgggatagcttagaagatcataacattttatattctataatcacaagatgcatcccccattttttttccgtaagtgaccaaaaaaaaaaaatgaaacttcttaaaatgtttaatgcaggccgtagtacatcaagaaacatatttaactctcagaatgatgatgctagaagccaggacctctgtgccttttgcacagcctggaaagcgtctggagggactggtggtgtctagcactttatctacagcacgtagagcatgcctttcctctacttgctccccacccacacagattcgctaaactgtgagtaaatgaatatatgaatacatgaatgagcaactggcctttttatctaaactttttttcatgattatagcaaacttagacaactctgtagtcaggatagatacatgaagtgagtgatctgcctgaacaatttggggaatgataatgattggtggaatctgccactcctagtggtaaataggattggatgtgtaaagtcagtggcagcacgtattatttttagcttccgacactgatgctgtaagatgtgatcttgctgcttgatagcctcacaataattatttacaagctctttgacttcattgacttggtatcattcacctcttagaacatttcccattttcgggggttgatagaaagcagttatgactggaagtgctgtgtggatacaacatggttttatgatctccaagtcttacctgctaatggcttggttttgtttcttccagtgaaaaaggcgattgagttgaagtcaagaggagtcaagatgctgcccagcaaggatggaagccataaaaactctgtctgtgagtccctttcctttctatctgaggattgatacgcccttgtaagcagaggagagaatggagcagttaagaagcgatcccacccaccaccttccccacgttatctcttccttcttttctatatccaaaagtattttctgggagaaagaacatgcactaacttcactttgttacggaggaatgtcgtggtggttctaactcctaaccatgtgtcacgtctgccctgatcactgtctgagactggaccctccagatgtctctcttaagtatatgtgacacggtcagtcattttcataccagtctctctccgtccttgcacaccccacacacaccagaccagactgatctctgcaaaggagaagttggtttttgtcttttgtctattgaaatattattgaccattcactgcctggagagtaaagtagctttcgggcaatgtctacgtccttccaaagagaaaacaagatctgcagacatgtctggctgatgacttttgcacgtgcccaggacctggtagataccagatcaatagctgtgggaggaatgaaggtgtctcccacacctgccattttggtgccttctcctaaatgcccatcgtcatcactcagccataggaagccctgaccatgcctggactgggtcatggtgcttctctgccagaagggccctttgtcctttagctgaaagccaacagcctatgtgctccttggagactcactatgcagacccttctttctctgcaggtgcagtcagctctccactggttttgctccccacacgaccttacacatgtcataacagttactgggtaccagcttcactgagggtttgcttttcttacaaacgagagatgagtaccgtctactgagataccaagtgggttgacttcctgtaggggccgttttctgctcacgcttcttctaggactttctacccattgggttgtgttttctatgcttccctggcaatcttttcatgtgatgtttctagccttgctctgtgggtgcgcctgtccccggtgttttgcatctgtgcatattgtttttccgttgcctagcaattagtggaagggctgggatggacatctgaaccctctcgggtcaattctgtttacatctgcatgctagagcagacttctgcatgaggttttatatgcaacaaatattctgctaaaactaataaaagaaacaatcacaatcttttgacaacgatactatagattgacctacatctttatcactttaggatttcctgacaattgcttgtgtgacaataatccatagtctgtgctcagtcctgcgcaggttgagaggacagagaggtaaacatgtcccctgggcctcagaggcagagaggagctaccatactctgactacccctctggtcttaggtgtctcccacttccaaaagaaaaaaaaaatcaatctgtaaatgtttgcatggcactttctattgaataatcacagccagtcaccctttaatgaaattagattggaaaaggatgggaaaactgaagggaaaaaaatctgagaaacagtagaaggaataaagggttttttaaaaataaaattttaacattttgatattgttagcttttagtatagaatgttctgtagagggagatatagtatttacagtagtttgaaaatgatttttatgataaaaccctgcacaaatgatctaaagttcaatgtagaaccacatatccggccaaactcttacattaaatcaatatcaggttggatatccgatcatttgggcatcagatttttctgctactgtaagattgaggcagagctttttttcttttgtaataaggagaatatctcttctgtcctcatctgaacacaaattgacatatgcataatgactcatttggtattagcgttctgtcctttcttttaacggtattaaagtatttgtcaagcatgggaattaatcattagggaaaatgaggaatggaaaccttgagccttctaagatgaggaaggtaatcaatggtaatgtgtcattccaaagaaaggtatgacagagaaaatgaaattgtttcactgatgaaaggacatagggtttgaagcgacaggcaagcattcaatagctgtgcaagtatatgccttattcaagttcaaatgtcatcgcttacacaattattaataaaatagtaatcctttccatagggttgtcactccgataaatcaagaggggtgtaaactgcctgttgcagagtgtggcatgcagtgggcattctgttcaccttaggagccttccatagtaaatggagggaagtgaaccacacggggcgaacggtaggggaggtaggcacaggccaggccacgttccagcgcgtcatgcgtgccttaggcgttcccaccatgagccccgtttcctcttcagcacctcatgaatcctttaccatctgtaggagactgagtatgaaagtgctttacgttcttgatacccaaggtgacactggctgcccacatgcctattgctgacatgaggatttcatcttctgtctgcagggagtgaagtgctggtgccttcagtggaggcctcattccttttcaagccattccattaacttgagtctctccacttctgcttcaccccaagatctgggttcctctgggagaccacagttcttgagattctagagattagatccaagcacacaaacctctcttgcagaagtgatataatcctttccccaactaagggttttgttgcggatatgacagaagatttatggaaaatgtctagctcagggtctgcaggcactgttagctcttgttccacagccccctctgtttgcttccatcttagtattttttattctgtaagctggacatttttgtttgtttatgatcgttctttttcagaagactcccctgggagtaaaagaagtgacagcagtggccagggaattatctgttcactgtagagtgtgaggctgtccccgttaagaagttttcatccagtgctggcttcaccaaagccagacaggggtggacactgctagcagctcctgtattctgcccgtgggaagcaccagggtatggatggaaggctgagctgcctcctgcagccccctgaagctgtctctgctccaaggcacaaaaatcagaggtcacagctctttgcagagggtgaccttgtgcgttcatgtccctctggatttcagcaccaacttgtgccccttgttgccttcagtgcagaaagcagccacagctcagtggcgactccttcccctgccactgccctgtccctggtggtgtccccagattcacccttttgcaaacagagcctttgaaagtagccttgcctgactggcttcttctccaaatgacatctgtttcctggtgggaccctgtcatggtgatagaaaatgttcaaggttttggtgaattcgagagggcaagttctacccaaagttctagatgttaaaaaataaaagtaaaaacaaacactgggcaaagcaagaaatccatgccctctgactatatcagatccacccaaagtcctgttcattattaccctcccctctgctcactgtcagggcatcagcaagagttcagcaagtgcaggaagaaaaagagagagatcatgacaaggaatgggagaatttccctgacagcctcaggaaacttgcagtttgataattaaacagatcaaggtcagtggtctggttgtctaaggtgttatccaagcttattgtctcatgaccaagaaaattaaggggcgtggccacaaagggtgaggttggagtgaaagtttaataagcgagagaagaaagcttttcacaaggcagaggggatctcaaatgggttgctgctttgacagctgaattacaaagcttttatgagaaactcctcttatctctctagctgtttgagtcacttttctaatctgtaaagctgtctgcataactaccccttatttatgttgttgtggttatgtccctaggcaagtacaaagtaccacttctcttgtttgtataactgtggatttgttttaggaaggccccctcctccctgtgtgagttcctatggagcccactgggtatatgcctgaaaaagggaggaaatttttcctgggagctcgctaatcacgcaaagaacagaaggcttctgtgctgaatcctgcttgctcatctgtccaggtgcagactgacttttcccaggctgctctatttttgcctgtagctgtgatttttcaggccggctgcatctccaacaaccagccttcactgtctaactgactggtttttttcttctgccacagtgatggaggactgctctaattataagacttaagagagctaagtttttttgtttttgttttttgagatggagtttcactctgacacccaggttggagtgcagtggcaggatctcagctcactgaaacctctacctcccgggttcatgtgattctcctgtctcagcctcccaaatagcagggagtacaggtgtgtgccaccatgtccgactaatttttttgtattttcagtagagatggggtttcaccattggccaggctggtctcaaactcctgacctcaggtgatcttcctgccttggcctccttaagtgctgggattacagtcatgagccaccatgcccagctgagagttaagtttatacaggtatgtaatagctggccatagatttaaaacaaactcctgcttttttcacttgaaagatgaaagtgcctgtgtttggaagtcgtgcacatcctgcaggctcatctcttcctctgcttcttcctgctaggccagtgaaatttttctaccagacctaccttgattgtacctttagttcaagatgagccccttgaaagtttggggttttcccatccatgacccacagatcacacaccatacctcctcatcccctgacagcccaagctaccagtacacaaccagtatctactgatgaatgaatgaatgaatgaatgaatgaatgaatgaatgaatgaaaagggagaaaggaatctctgtgctttggaacaaaagccctatagattctttcatttatgcctcctaatctgatgagtcttttgtgaattttgctttgggaacccacgttcatcagcttctttacacagccttgctttcaaccctccacaattcatttcatcattaacatgcacaaaacctaaccacatagggcagcgcgactgtagtctttagagatatttcaactcttctgtgcggtgagggcgactctcaacattaagtgtagaatgagaagatttagaatttcctttttcaccagcttgtaatcagtaatgtttgaagaaaaacccaaagatattaagatagtcattaatatcttaaatatctaagtattttataattacgtggtttatatgctctaaattttgaattattttattcttggaaaaagtgcaatgtaaatgggcaatattatgtctccaaaagggcatctggaataaactgagcaagcacccatcccccattttctttctcaccctgaaatggtgaactgctctttattctgaaagtagattatttcaataccaaagaaattattaaactgacactgtatatatttgtttgttattgagacagagtctcgttctgtcacccaggctggagtgtggtgcgatctcagctaactgcaacctgcacctcccaggttccagcgattctcctgcctcagcctcctgagtagctgggattacaggcatgcaccacgatgcccggctaatttttctattttttagtagatatggggtttcaccatgttggaaaagctgatcttgaattcctgacctcaggcgatctgcctgcctcggcctcccaaagtgctgggattacaggcatgagccaccgcacctggccagcactctattttttaatgatggtaacagtacctgtcatttcttcttcttcttctgagcattcttcttggcagaaaccagttttagcagctctcaatgtgaggattactaaagtagataatctgtggatgcccttctaactccaaaatatatacatctctaggaagaaagataaacaaaacattggttgttattttgaagtagagattttccccacatgtaaagttaaagacaaatgacttgcccaattcgatattgatttgttgtagctcactcagatgagctgatgggacatgctgtgtacggaggagcatttgcagttacaacactttgtagccatgcaggatggggcaattaatccagaaccattatttaataaaaagatgattttttaaatgtggaaaactgagcactctaatgcattgcctttatgcccctgggaaaaataacaacacaacattataaaataaatgcccctggaattctcctgtatttaaccataaacgttcacttccttgctctttgtttgtattgggcaatcaatgttttcttaccctgaaaagaaaaaaaaaagagacctgaagcaaaacagaatgatattcgcccctagtttccaaagagacagttcagttaatgaaaagcaactgatggactcttgtccttcataacgacacacagtggttccatctccctctggcttttgttgtggctcaggcataatttggaagggcagattttaaaacttgtatctctgtttttagaaggccacataaagtgatgtctcaattactgtatatacttaatgatgtaattataactgtagagtgtttggattgtcttttgtaaataccctgactgattgaaccattttgcaaaatatacttcagaaaataattttccacttgtatttatctacttataattataatattcgtagttttagttgtcttaagtttggaataatttatgaacaaataaaatacactagtgggtaatcttctcttaatcgttaaattccaatatgctaaaaaaaaaaaataaggtttaatcctatatcctgaagagtcttttgccctcatgtcagcctctgagtttagcaccataaccgccagcagcagcttcggttcagcccggggacagactttcgcaactgttctctctctgggatctgtagaagctgagacaaagaaaaagagaagtcatgaattatcatgaatagggctaccatgagaaataaagagagaagaaaaccagctcactcatattcatcttcggaaagttgtcccgagatgatccaattccagaatggactgaggtggattacgtggcttaacctgcatttctcttctacgggccagaacttcctatccacgggcttacttgggagtcacgttgatgtctaacaggcatctctctccctcttacctctcacagaagaagtctgtgacttccaccattcagtccctagaccttcacagcacccctctctccggcctcttggtgagccctgactgccccccgacatatcccaagcctttctcgttacccccaaaccaccgtcgcccctcacctgtatcatcatgtcatcctcagcctctccctgccctgacaaagtcccaccctgcaatcagaaggatctgggtgaaatatcagtagaaccacatccttcctcttctccagaccctcaaacgtttcccgtcacaggcagaacgagtccaaattccttatgaagacccaaagaactcctttgctcccacccttgcatcctggtcctcttggtttctgggctgtttcttgaggacattggacactcaacaccccagggactttgctctcctctctcctcagcctgaaataatgtcccaaagaagccgtatcacatcctccctccctcacatcgtttcttaaaattcgctttctctggcagctgtcactgatcaccctaactaaatatcatgtatcttgagcatccacaacttctcccatccaagtactaaccagccccgaccctgcttaggttccgagatcaggtgcattcagggtggtatggctgttgacttgagcatccacaccttctatcttcttctgttacttgctctgtttttgtgttttttaagttattataacatattacatatacatatacgtgtatgtttatttgagtgtgtatcataaacacacacataaagtaaccctgttcatttcatttctctcacatctcccagtagaatataaactgaactacatgagggcaggtatattttcttttgtaaaaaattatttttcgtattttttccataagttattggggtacaggtggtatatggttacatgagtaagctcttcagtggtgatttgtgagatgttggtgcacccattacctgagcagtatacgctgcaccatatttgttgtcttttatccctcgccccactcccactcttcccccaacgtccacagagccctttgtatcattcttatgaggacaggcatattttctactttgttctctgatctctactaagaatttataagagtctcaggaacacaacagatgctcaggtggtgaattgaataacccagggatgtagttatgggatataacccagggatgtagttatgggatataacccagggatgtagttatgggatataacccagggatgtagctatgggatataacccagggatgtagttatgggatggtgtgtcgtgtgggaagagggtgctcatgtttttcttcaattagatttttatatttcacatcttcactcacacattcaacagtccctcgttgcggagcatccagaagctgtcataaagatgatcagcatctgttccttctccaggggaaattatagtcttatagtgtttcagatcaccagtaaatatttgtcacacagagtgctgtcataacggtagtaacatttactgatgattgagtaaaaatggaaattcactatctttcaaaatattagtagatcaacccataaaatatagaaatccatagaaatagaggatggaaagccgtaggaaagcagggccatgtgaggcgccaccaagtcctctttaaaggacttcctccgtggctgaaatgtcttatctgtagacttgctaggtactggctaagagaaaactgtgcccattatcaaaatgttatgtgttgtatggagaaaagcacaaataattaaataattcatccatgtcagtaaaacacactagtttcagaatcatgatatccactgcatggaaggaaacaggaaaattatgagaaatttttcaagtttctgtcacaaggtgatagcagctggtaataaaaactaattgtcagtctacattgtgtgctctagtcagtcagaaaacacagtgtaatgtactaattttcctccatcccactgctgaaggagttcatttgttactgagtcaatggctgagacatgcttgcttttaggaaggtcatttgaagaatttcagcgaatgcatgctgcctttctgcagagtgcttcgctagatccagagcttgaggtgggatgtgggtacaaggagggtgggatgaaaggaaaggagaatggagtgaggaccttcatcagcctggatgcctgacttagaacacaggataccacagaatggaagttgtgacatgtcccctaatccaatcaattgcaaatgatgcttatgtagtttcaagctcagaaactttatttcagaaatcattttcccacggacattttcatcaggccataattttccagataaccagatacattttcactctattagtccgcatatggataatcttcagtaatgaacatgatcctctttactcatctgtgagaaacacattttgcttcacaataatattattaaggaataccaggcgtgttactagattgccagaaatgcctctcatcatcaggtcttgcttttagggacgcgagtgctgtattaggaacgtgtgatttatctgaatggtagtaggccagagtgatttctaacactgctgcagaagcaggcatgcctgctaatccgtgtgccagatttctagcactaagtgctgtaggtcttgctttaaagcagattttgacggtaggaaaaataatagcgccattaacctctaacagtagtataaaggcttaataaaacaagaaggagaattgctctaatctagtttgctccatcataaaatgtaataatggagttttgcaattgttaaagaccctgttttcttagcaaagacccatctccatataaaacaaatgtagtagattgtaaaaaatgcttcatcagtcaggtaagtaaattatgcttccactttctaaacaggcgtttgtcactgcagaagctaaaatatcttttcaagtgctatggaaaatattgctgtgaaggggactgctgtctagatagatttgagaacagcatcactgggaactagaagcaaaacaagatgtttcatcaattattcatcataccgtttatatcatataattttttaaataaacagaaaaaaaggatctattaaaatacataaaacaatgtatagcctgattggattacaggtggttaaattgaattgtaaccatagaagtaaaatgcttttcaagtggtttcagcatacaattaaagaatataattgattcactaaagggaaaaactcactttgcgtaatggctagagagcacattcttttacctcaaatagtgaatgagaaacaacctggagatgatggcagacctaaaaaaggaagtataaattttagcatttccatcactactttttagaagtgcattgtaacacatgaattttcatcaaattttatataagaaaataactaaattactttctattcctatgtaattggatgaggcaatctctgaacctctggaggattatgaatgattcatgtttggcgcccacagagtcaaaacaattccagcagcagtcagaagggggaactgctatattcttgtaataaaatcatcttacatgagcaagtctttgttagtgagtaactaaagtcagaaactttaaaaactaatcaatgaagctttcttatcaattaaagaattccattttatacacaagcaaactaagtcagcaagataattaattagccttgatataaacataacgaagagaccaagagttaaatatcaagatgaactcagatgatcaaagggaattcagaaaaagtacatatctcttaagcctggttttatttaaaacacattttaaaggtgtaaggagaaaaccgaaaatgttttctggttaaatcctttcattagagtgcttacagaattacagaatcatgaaactgaaactgactaccattttctggagagaaataagttttgcccagacttgataatttagcctcactgaatgaaaagtttcaaaaacaaaaaagccaatttagactgaatgatgattatgctgattattgatgacctagcaatattgggcctgcagttattcatggcatcaggagaagctgctaccttgtgtctgccctcaatggaagaggaatgtgaccacattcaccagaacccatgacctactggatcctggggcccctacgatctacagtcccaaactctatagtccacgtggcccatatatggaaggcaaagtgactgataaagtgttctctttcataaatctattttcatgggagttcatatgagctacactaatatagaaataagggaatttaaactatgggaatacattttaattcaaatgataaagagtagaagaaatatattttagaaactcctgttgaccttatttccatattcttgacatctagtttataacttgatcctatactttaacgattaaaatggacaattggacttcccttactgactgttgtcttatctgcaaaatggatgagctttaatgtgcatcagggttatataatgatgacgtttcaatcttccaaagcgctcatttttttcctgatctgcccaaattaattaccacactaattggattaaattagatcatttaattacaccaaatgattatattgatttgctttagcatttctttcgtcacatccgttgggttcactgcatttgcattatattcacagagaagagatgtgcagaagcagtccatggtagcttatgtcagagaagaaaactaagtcacgtttgaagatatgtgaaagtatacgacaagtcaaagagataagccaaggtgaacacattgggtaattagtgaagtgcttcggagatggaaggcaccatattttgcatgcactgcatattattattattagaatacttgcaggaagagcaatgtgcctgtctaaattgcctattttatggtttgaactgtctgtttgaagggcatatggaataacatcaaccatgtgacatccgaagaagatacgttcattatgtatctgggaaaaccatggcttcaagtgaaaattcaaggtaactgatatgtaggaaatgtctcattccctgtcccccataagaaaatcttaacagcttttttttgcacgtgtgcaaatatacaaatggtaggtcttccacaagtcatatttctaacactggaaaaaactatcccatatcttcaagtgtagtttttggaaggtctgatttgtcttgttcctacaaagatagaaaataattagaaagatatcaaatgagtacaatgaatataccttgtaaaaaatataatggtaatttctgtgaaatgaaacaaataatgctattttaagttggaaaagtgtttgctggttgatttataatctgaatccagttcatcatgtattgaatatgctcagactagggtttagctgtcatccttccttccagccaaactgctgttttagtaacttttaaatacaatttgctagaatctttctaatcattatttttaatatatttcgacctaaatttcctttctggatgcttttgtgaaacacgtgaacattttcctctagtactatcatccttcaaaataatattattcttttatttggtggaaagcaattagcaaatattatattattgttctcttctgtatctgtgataaacgctaattatcataaggtaaagccagatttgtatttctcatgattttatattaatattcaatctaccaagaggattaattggagtgtacctaataaaagtgagttttagcatacaggacacgttgagtcattatttttttttgtggttatttgtcatttcttacaggaaattaagtgttttttggtaaagggcattagcttgcaaattctgcatcgcggcactataattttagatggattaatatccttgcccatgttccaaagtcttccagcgtttattgcatctataagataaacctggttttcagacagtgtcttcgaggtccttggaaatatgtccccctgtgctcctgcaatatccttgtactacacttcttcaataaccacacacacacacacacacacacacacacgcagggcctccaattcttttgtgatgttctttcttccacgtgactttttctcttccaaattccctttcatgtcttcgtctaatgtcctaatcatctttaaaaactcaggtaggatacaattttcactacttttcttgacatactgaactggcaagctacacgtggtgctaatgatgtgcgatttcccctcacacccagaatgaatccagcaggtttctatggtctttaggatccggtattgcttcatgtcctggctcattccttgccgcgttcccctggctccctgcactttctgttacttctgcttggaccgctctttccacttcttttttggtgttgctttcgaagcagaatggcacctgcttcctccaggttctcccctttcattccctctaaagcccacagcagttcagtggagcacctcctccactgctgtgtccacccacccagcctccctctcatgcccagggctgggtccttccttttctcctgagttttgcagggtggggagtctcgggcctggccttccactgaacctgaacctggggatctcacccggcctcctgatcttaaagactgtctctatgcacatgctttcccagatggtgttttcggcctggccgtctttcccagactcatgtatgcagctgtctgcctgacacagttactccctggtgtgcagcaggcagagctgttgatcagtcttctgggtgtcagtttgggaaaatcctcagcctgagtgacccctgtctgtctgctcagtcatgctgctgtgctcctggaagccgacgtctaggaagtgaggtgtggacccctgagcatgaccaggctcttcctggactccatgacagagctatggcctccctgggtttcagaggtccctgccccatctatggacacattcaccttgttggtgagatctgtgagcccctctccagcatgtacacacacaccacgccacacacagcaaacacacctatacccaaaacacacacaacacataacactccaacacacacaacacacacacactaacacaacacacatacccaacacacacacaacacataataccccaacacacacaacacacacacactaacaacacacatacccaacacacacacacccctatatccaacacacgacgcacacaccataacaaacacacacacacacaagacgccaacacacatctatattcaacatacacgaaacacacatacagcacataatataccctaacacacacaacacacacaccataacaaacacaacacacacacacacgacgccaacacacatctatattcaatacacacaaaacacacatacaacacacacaccataacaagcataacacacacaacacatacattttctaattcccgttctgtttcatttttctctttatatctttttattacctaataactacatatatgtacacatttatttattttgtttattgtctctctcatggaataagggtggggattttagtgttctattcactgtagaactgtgctggggacattgtagggctcagtaacgatatgtataatggataaatgaatctccaggcggctgcctgctgccataatttgaccagcaatttcagtatcaactcctcgtatcaatacccagctaagtcagcccacccacaattgtcagcctatcccacactcttaacaaaagtcattatattccacattactcggattttatcatttcttggacatctgacaataattgaaaaaaaaattatcatatatatatttcattttctcctagaatataatctcattgataagtgaccttgcatcctacttggttatatacccagaacatattatgcctgttgtcgtgacaagcatttgatgaacagtattgattcattgactcctgaccaattttactcactatagcaaattacttgacacagtgtgggtgactatctattggtatctatttatctctatgtattgatttgtattcaacatctagaataaatgtattcctgattattactaagaagaactttaatattgtaaaccttcttaagagtttaccaatataatattaatgttacttttgatgataaagaagtcatatccaagttaatcacacaaaaaaacaggatcacttttttttacccttctattttgataattgaatggcattttgttaggatataaagatcaaagtaccattagaatattaacatttttccaaagaaacattactaatgcctaataatatttttgccatgcatattagggtccagaggtctcagaatagcctatagtaaaaggcacatgggcctcagaaaagttcattctcagaaattgttgtggccaggcgtggtggcttatgcctgtaatcccagcacttctggaggccgaggcaggcagatcatttgaggtcaggggttcgagaccagcctgaccaacatggtgaaaccccacctctacgaaaaatacaaaaattagctgtgtgtggtgacatgcctgttatcccagatgctcgggaggctgaggcaggagagaacacaggatgtgaaggttgtagtgagccgatatcgcgccagtgcactccagcctgggtgacagagggagactccgtctcaaaaaaaaaaaaaattattgttaaagtataaatgtctggtggcttaggtcgaaggaggcacgttagaagtgacaagctccacagaaagcagcgagtctctttcctgagtctgtttctctgagtctcttcttttgggtatgtggtcataacttgaagttcagtggggtgtatacaaattgtggtggtgctggtgaaatcgcaggatagcgactaagggggctgtgaaggattttgcccccaggacactgaggtgtatggggcataacaacgtaaagtcaggagaaacaatgttgtagggccatggtcattagcggctgggataggagacccggatgcagtggcttccccaggcctctccagatgagtcagaggatgattgcgaagttgactgagatctcacccggagcaggcagatcgctgagtgacggctctgctgatgatgagaccagatgcccagcatcctgtctcatgagctggacaaagaccgtcattcaggggagtgaaatgagagctcttgattaaaataatattggagtgtgttttcacagtgaaacatgcttaatcttgaagccatagaagtcatagattcaaattctgcctgaaaatattcaagttacagactctctttcatcatatttttagatcactgaaactgcctcttttttttaaaccaaagagaaataaatgtgtaaaaaatggtattgagcctcattttctcaaattctaaaatagcgataatatttaccttatagggttttatttgtttattacattgctataaaaaatacttagcccagtgcctgccacgaaagggtacttaggaacactgtcagttgttatatatttttgttaggataggatagaagccaaaggttggaagattataaagttatgtgtaaatacaattattcattcaggtaggtcctgagcttcctccttggctaggccaagtttctagatgccttgcagtgaaacattgaaatagaaattacagactgtgttgcataaaggaagcgccaatcttctcttcattgacacagttttttgtttgttttgtttttgttttttgtttttttgttttgtttttttttttgagacagagtcttgctctgtcacccatgctggagtgcagtggcacgatcccggctcactgcaacctccgcctcccagggtcaagtgatctcctgcttcagcctcctgagtagctgggattacaggtgcctgttaccgtgcccggctaattttttgtattttttgtagagacgtggtttcaccatgttggtcacgctggtctcaaactcctgacctcaggtgatccgcctgccccggcctcccaaagtgctggggttacaggtgtgagccaccaagcccggcccattgatacagttttgctagaggatgtcgccatgtgtgttagagagaaaaagatactttagtaccagggtaaagatgaaacccgtcagcactccccaccctcacacacaaacatgcattaaccagtcaaatcatggggccgacttttactttaatttatttaattattcaatttatttgttgttatttaatttatttatacattaaatgaaatcaatgtatttgggtaattagaccacctattcaaagaacctcaattttgctagtttagaaaattagaatatgactattcctttttttataaattaaactttatcttataaaagtaagaaaacatttaagagtatctcagtacaaactgtggcaaagatgtatcagctatgcgctttatgtacttctcagccttcctacaactccacacagcccctaaggacaaattagtgaaagaatattttgagagtggaagctatgatatcatcacagtaccgttgaatcacatctcactgatgtaaaaacacttgccagggttggctaattgaaaagtagatgatgactaacagtctatttgggaggcgtcccctagttagtacagacattgtattgccccacatgttgagaagccttgaacactactgtgacagtttacccacatacagaagaaattgcttcaaatattttatcaaaggctggcaaattttagattcaggtaatttttgttttgttttgttttgagacagagtctcgttctgtcacccaggctgcagtgcagtggtgcgatcttcggtcactgccacctcctgggctcaaacgatccttctgactcagcctcctcccaagtagctgggattacaggtgcacaccaccatgcctggctaatttttgtattttttgtagagacagggccttgccctgttgcccaggctggtctcaaactcctgggcttaagtgatcctccggtctcagcctcctaaagtgctgggattacagatgttggccactacgcgcagcctagatcaatgtttggattacatttattattattttatgtttgctaaagcaagaactccatttactgaccacccttaccttgttaaaatattaggcatatgtcagtacttactggtgacactgtatagcacttttactacttaattgatgaacgtgattatttgcagctttatttaatttgaatcaatatccctatgaaatgctggaggaaatatctgatttaaagctcatgttctttctgagcccagtagtttggaatcatggtgtctccaatgaatagactgtaactttgtgaaaatcactttataactctgggcctctgctttatttagtgatcatgttttcatcactaaaaagggattgattatagtactttactcataggattgacgtgaggattaaaggagatgactcgtgtaaggccttcagaaccaggcctgccacatagtaagcacactctaaatatttctgttcagtggactaagagtgaactgaactgtccttaggtgaatgttgaagacacagtcaatggaaatggctcctccgggaaaagaagaaaatggaaatgtatgagcagagtgagaataaaaacactattctgtcttcaagaatctttctacgtctatccataattacttctaactatcccgccatttcctttcttcctgaaacattgtataaccgaaggggactctggcatttctgatggcatcagcaagggtggtatgaggggaggacaatactggagttaactagatcatctggagatggcttagtccaatgttagccacaggcccctgacgctcagctgcaagttccatgattcacttcatggtaactgtggataagttagaaggtggggaggtgtgtaggaacttgtgtgcagctccctgaaagtcatgacatgttcccaaccttagagcgcgttgtctcacaacttaaaccaaagcatggagttgtttggttgctgttatttttctcattttatgatgagttgggaataagtgtatcagtcacatgtttacttagatgacccttagattcctgcttataaaatcagaatattgtacataactctatgcagagcctcgaaagtgaagtaaccctttttaatttcataatatttcattcatttaattacttaattttcactttttttaactttttaagtttgctcctttgtctgagatctaagtgagtctatttctgatctctctattctttttaattgattgctatcagttaattaaccactattacactgttttatttactatagtattacagtatactctagcatgtcagaatccgtattatgctacagtttcacccagcaacttttaaagtaaatattttttaattgaggagaaagaaattcagagtgccctacagaaatattgcagaactgccacgaaatttcatttcactgaaaaatctagaatttgtatttttgctaagtggccttttccccaatattttattgtataaataataattatgagcattgctaacatttattaagcacatgcattgtagttaagttttgcacatgtgataaagagtaacttttcattataactacatttcctcatttgacattagggaacagagacacgtaggatgagtcatttgcctcaaatcatgtagcagtttcaaagtctaaaatctaaattcaaagcacctctgtctatttctcaattcctcctttataaatatcactggatgattaaactttctactggcatttgtaaggcttagcacatttaaaattggtcctttacacctctattatagtccgtttcaaaagaaaagagacaatatttgtaattttgaataaaattatactatcatctttgcccacttacgcatgcaacaagtattcattgtgtccaatttatgcccagctctctcatgtatttttattgtgtctaaatataaggtattgcaattacttcgaagcagataagcacactaagtggtcattgtttccagcctgctgaacttcctgaggaacaaaaagcagatgcagtgagcaaagcaatccatttcggtcacgctgaaaatttgcagatttaaaagagagaagccttaaaattcagataagcaaatatgatgatggaaaaggaaacaaagggttggtaggaggtgcagagaggcatttactcagagctcacagctgctctgtccccaggtcatcagtacggactctggtcctcactgagtggagaccaagagtggactgagagagcagtgctacctttctcgagagagacttaagtggagcaaagatcaagtgtttttacaggccagacttggccgttactcaaggccctgctgtcttcaagatagcagcgtgcttccaaaggccaccagccatcagttagcacggtggggctcagggagcctcggtcctagcgtgcgccactcagcacaaatgaacaagggcacagtgctcggaacccactgaaatcttcaaagagatccctacaagagcagttcattgaaactggaagaaaaatatagcatttacacagagaatatctggaagaaaagtagagaaaattaaaattgagatggttgctttttgtaaatagatcttactgttttattgctttctcaataaaggctctgcttccataatttatttgagaggcaagttttccagcctaaaattagaaatgcagagttccatatccctgctcaccatggattttaatagaaaggggacagagtcagccttctgcagccttacatggagcagatcaccttttcatccatcatacatggggtaaccacagacttttttggtcctggaaatgctaagctggacttaaaagcaacaaagtgaatgtggacctgccctgggcaaaccaagatggaaggttgccttcctatgagctgcacggaggtgcgttcagaggtgtgatgcttatatcatgcttgtatttctggttttaaattagtataggatcctgcattttattggacatacatttggtatttgatatccaatactgtcacatcctcataatttttttacatctgccatccacccctacttgaccagtcacatctctcctgaatgtcctgatacgtttgaacaagcttcttctatgtggatatggaaaagacaccccccagtgtaggggagacaaagctctactctgtcctcttacggcccaagaatgaaatcgacataagaaagattaacaggagaaaagcatgcaggtttatttaatgcaaatttcatgtggcctgggagccctcataaggaaatgaagatccaaagaaacagttacaaccagccactgatagactggcttggacaaagaatatttgcttgtgaaacgtggcaaggccaagggacttgggcgagggtaagggatcggctagagaagtgaccaggtggataagtgttagtgtagcaaggtttgtttgtatagatatccctgggcttcagttttctgtgcttgatgataagaacactgcttcccttttggtatcaagacagtatatttcgtatgggaattctatctcctgctttcaatgaacagaatgacatgatcttgtaactggcttttttttaagcgtctttaatttaaacatgccagagcagcatatggtggggtggcatattcttaacccatccaccagcaaatagagaagtcacgcaggatgcaactctcatcgtcagtgtggcggcacctccctatcctagaaaagtgaagacaagcgtagagaagtgaaggcgcttcctgaaagtcacagtgttagctgtcaatgacacgtctcttgacactgcctttcctagcttgtattccaagcgctctgattatccacgaagtcagtaactcaagggggtgacccacactctaacttcacagaaacaagcccaagcttaatttcaaataagaattttgaaacctacctaatagtcccatagacagtttttttttctttttgataaacatagaaaactgacccttctgatggttatcagaggctgataagaatagtgaggggtgggggcaaggagcattggttggttaatgggtacaaaatacagaaagaaagaaagaataatatattttatttggtagcaaaatgggaaagggtgaatatagtaaaaaataattgtacttttaaaaataactaaaagagtgtattggattgtttgtaacacgaacaataaatgtttgatgggatggataccccattctccatgatgtgattattttacgtcgcatgcctgtgtcaaaacatctcatgtactttataaatgtatataacttcaatgtacccatagaaattaaaaataaagcaataaaacatgttataaaaaaaaagaaagaaattgacccttctgatcttaaggcttgaaattgcattgattttctttgacttccttcctcagaaaagcacccccaggcctctaaaaacagtctcaaagaaatgaaactcaccagatcaccatatccaggcaatgagatgccagatgcttcactcctgttttgtaacccgttgttacatttttcttcctgttatataaacccctaattttagtaggtcagggaggtggatttgagtctgagctcccatctccttcggctgcagcatccgattaaagccttcttccttggcagtaatcgtgatctcagtcattggcattctgtgcagtgagcagcaggacccagacaggacccctggtgtttaggtaacagtttgatgatgtgtaatgaagattcaaaaaatttttacagggggaaagacaactagactgccgagtcattaaactcaacgtaatgggtacaattagccctgaggcaactttattttatagtcactatttttggtgtaaaacaagggcagtggcttcaattttgcaactttggatttgattttatccatcaatttaaatgtgactgaaatgatgacatcaaaacactttaaaaatccagccatgcattttctataatgaacccagtaaatcgttttataatgaagacatctcttatttttatttcaaaaactgggcttggatgatgctgatccttctaagtggagctcacttcagtccaaaaatattgattcccgtattgactttcctaccacaggttattccaaaggcagtttaattgtccactttggccaagtgcttcccggcatcattacaaatttcagaagagaatttagaactgcaataaagtatgtaagaattctgaatgtaataagagtcgtgatggaaatactagtttggaatatgatctatagcaaggagaatgagggtgactaaaattaggctgccgtcaagctctgactctattttaaaactgtatcaggtcccagctactcctctggaggctgaggcaggagaatggcgtgaacctgcgaggcggagctagcagtgagcggagatagcgccactgcactccagcctgggcgagagagcgagactccgtctaaaaaaaaaaaaaaaaaaaagactgtatcagtatctgcaactgggttcaacaatgatgatatagaaagacagtgccatttgtttctagatggccagtaaaaaagataaaatatatgttcataattagcaagcaaagaaaaatcccaaaacctatatctaaataaaattgttaagtactatgagtcatgcagatgaaaaaaatatattttgtatatatgtacttatatgttatacattttatatattatgtaatatacaacatgcttgtatgttttatataatatataacatatagctatatattttatataatatataatttatatattatatataatatataacatatagctatatattttatataatatataaattatatattatatattatgttatatattatatataattacatgttatatatattacatgtaacatgtaaatatatattatataaattataacatataggcattatatattatataaattatatattatataatatataatatctatacatttaaagttgcttttttcatgtttagagtaactatcactacattaaaatagaaagactgtctctttggtgttagtccattaatttgaatgtgttctaatgagttacttcatacttctcaatcacatgaagcaaaaggtgtgcattgtcctaaatttgctaaaacttagtggtctaacagtcattttttgaaatcaataaacatcaaataaaaataagcaaactgcgagcttaacattcatgaatattctttacatcttagaatgattacgcaaacattggttttatcaagttaacacaaagcagatgtggtttaactggaagaacataacattttaggtctggagacctgggtttgagttgaacctactagttgtaggagcttgagcctctttctgtctagtgtggaaaagagatgacaacctcacaggataattataggtattaaattaaaagagtatgcacatgttttcagcggaagacctggcagaagaatgatattcaaaaaagtgctttaaacatatttcatttttcttttggtttcaaatgattttttggcacagtgcagaaatacctccccctccaagtgagaggagggctgacaggtacctatgaacacccctccagaaatggaggattctaattctgaattccctttaggcagatagtttcaaaccattgcctgtaattactttagtgataaggatgcagtgcccagaataaacagctcactcgtggttgtataaaagaataaataagagaacacaatgaaagaactttgccttgactgatccatccatattctgggtccacaggctattcacaggggtcactgtctttatttttttatttattttttattattttattttttaattttatatatttatatgtatatttcttattatacttctagggtacaagtgcacaacgtgcaggtttgttacatatgtatacatgtgccatgttggtgtgctgcacccattagcttgtcatttagcattaggtatatctcctaatgctatcccttccctctacccccaccccacaacagtccctggtgtgtgatgttccccttcctgtgtccatgtgttctcattgttcagttcccacgtatgagtgacaacatgcagtgtttggtttttggtccttgcgatagatagtttgctgagaatgatggtttccagcttcatccatgtttctacaaatgacatgaactcttcattttttatggctacatagtattccatggtgtatatgtgccacattttcttaatcccatctgtcattgttggacatttaggttggatccaagtctttgctattgtgaatagtgccgcaataaacatacgtgtgcatgtgtctttataacagcatgatttttaatcttttgggtatatacccagtaatgggatggctggatcaaatggtatttctaattctagatccctgaggaatcaccacactgtcttccacaatggttgaactagtttacagtcccaccaacagtgtcaaagtgttcctatttctccacatcctctccagcacctgttgtttcctgactttttaatgatcgccattccaactgttgtgagatggtatctcattgtggttgtgatttgcatttctctgatggccggtgatgatgagcattttttcatgtgtctgttggctgcataaaggtcatcttttgagaagtgtctgttcatgtccttcacccacttgttgatgcggttgcttgtttttttcttgtaaatttgtttgggttctttgtaaattctggatattagccctttgtcagatgagtagattgcaaaaattttatcccattttttaggttgcctgttcactctgatggtagtttcttgtgctgtgcagaagctctttagtttaattagatcccatttgtcaattttggcttttgttgccattgcttttggtgttttagacatgaagtccttgcccatgcctatgtcctgaatagtattgcctaggttttcttctagggtttttacgattttaggtctaacatttaagtctttaatccatcttgaattaatttttgtataaggtgtaaggaagggatccagtttcacctttctacatatggctagccagttttcccagcaccatttgttgaatagggaatcctttccccatttcttgtttttgtcagatttgtcaaagatcagatagtcgtagatgtgtggtattatttctgagggctctgttctgttccattggtctatatctctgttttggtaccagtaccatgctgtttgggttactgtagccttgtagtatagtttaaagtcaggtagtgtgatgcctccagctttgttcttttggcttaggattgacttggcaatgcgggctcttttttggttccacatgaactttaaagtagtttttttccaattctgtgaagaaagtcattggtagcttgatggggatggcattgaatctataaattaccttgggcagtatggccattttgacgatatttactcttcctatccataagcatggaatgttcttccatttgtttgtatcctcttttatttcattgagcagtggtttgtaattctccttgaagaggtccttcacatcccttgtaagctggattcctaggtattttattctctttgaaacaattgtcaatgggagttcactcatgatttggctctctgtttgtctgttattggtgtataagaatgcttgtgatttttgcacattgattttgtatcctgagactttgctgaagttgcttatcagcttaaggagattttgtgctgagatgatggggttttctaaatatacaatcatgtcatctgcaaagagggacgatttgacttcctcttttcctaattgaatatcctttatttccttctcctgcctaattgccctggccagaacttccaacactatgttgaataggagtggtgaaagagggcatccctgtcttgtgccagttttcaaagggaatgcttccagtttttgcccattcagtatgatattggctgtgggtttgtcttaaatagctcttattagtttgagatacgtcccatcaatacctaatttattgagagtttttagcatgaagggctgttgaattttgtcaaaggctttttctgcatctgttgagataatcatgtggtttttgtcattggttctgtttatatgctggattacgtttactgatttgcgtatattgaaccagccttgcatcccagggatgaagcccacttgatcatggtggataagctttttgatgtgctgctgagttcggtttgccagtattttattgagaatttttgcatcaatgttcatcagggatattggtctaaaattctcttttttggttgtgtctctgcccggctttggtatcaggatgatgttggcctcatgaaatgagttagggaggagtccctcttttttctattgattggaatagtttcagaaggaatggtacctgctcctctttgtacgtctgatagaaatcggctgtgaatccatctggtcctggactttttttggttggtaagctattaattattacctcaatttcagagcctgttattggtctattcagagattcaacttcttcctggtttagtcttgggagggtgtatgtgtcaaggaatttctctgtttcttgtagattttctagttcatttgcgtagaggtgttaatagtattctctgatggtagtttgtatttctgtgggatcagtggtgatataccctttgtcattttttattgcgtctatttgattcttctctcttttcttctttattagtcttgctagtggtctatcaattttgttgatcttttcaaaaaaccagctcctggattcatcgattttttgaagggtttttttgtatctccatctccttcatttctgctctgatctgagttgtttcttgccttctgctagtttttgaatgtgtttgctcttgcttctctagttgtttcaattgtgatgttatggtgtcgattataggtctttcctgctttctcttgtgggcatttagtgttataaattttcctctacacactgctttaaatgtgtcccagagattctggcatgttgtgtctttgttctcgttggtttcaaagaacatctttatttctgccttcatttcgttatgtacccagtagtcattcaggagcaagttgttcagtttccaagtagttgtgtggttttgagtgagtttcttaatcctgagttcttgtttgattgcactgtggtctgagatacagtttgttataatttcgcttcttttacatttgctgaggagagctttacttccaactatgtggtcaattttgaaataagtgtggtgtgatgctgagaagaatgtatattctgttgatttggggtggagagttaggtagatgtctattaggtctgcttggtgcagagctcagttcaattcctggatatccttgttaacttgctgtcttgttgatctgtctgatgttgacagtggggtgttaaagactcccattattattgtgtgggagtctaagtctctctgtaggtctctaaggacttgctttatgaatctgggtgctcctgtattgggtgaatatatatttaggatagttagctcttcttgttgaattgatccctttaccattacgtaatggctttctttgtctcttttgatctttgttggtttaaagtcccttttatcagagactaggattgcaacccctgcctttttttgttttccatttgcttggtagatcttcctccatccctttattttgagcctatgtgtgtctctgcacatgagatgggtttcctgaatacaacacactgatgggtcttgactctttatccaatttgccagtctgcgtcttgtaattggagcatttagcccatttgcatttaaggttaatattgttatgtgtgaatttgatcctgtcattatgatgttagctggttattgtgctcattagttgatacagttttcttcctagcctcgatggtctttacaatttggcatgtttttgcagtggctagtaccagttgttcctttccatgtttagtgcttcttcaggaggtcttttaggggaggtctggtggtggcaaaatctctcagcatttgcttgtctgtgaagtattttatttcttcacttatgaagcttaatttggctggatatgaaattctgggttgaaaattgttttctttaagaatgttgaatattggcccccagtcttttctggcttgtagactttctgctgagagatcagctgttagtctgatgggcttccctttgtgggtaacccgacctttctctctggctgcacttaacattttttccttcatttcagctttggtgaatctgacaattatgtgtcttggagttgctcttctcgaggagtatctttgtggcgtcctctgtgtttcctgaatttgcatgttggcctgccttgctaggttggggaagttttccttgataatgtcctgcagagtgttttccaacttgtttccattctccccgtcactctcaggtacaccaatcagacatagatttggtcttttcacatagtcccatatttcttggaggctttgttcatttctttttattcctttttctctaaacttctcttcttacttcatttcattcatttgatcttcagtcactgataccctttcttccagttgatcgaatcggctgttcaaacttgtgcattcatcacgtagttcccgtgccatggttttcagctccatcaggtcctttaaagacttctctgcattggttattctagttagccattcgtctaatcatttttcaaagtttttaacttctttgcgatgggttcgaacttcctcctttagctcggagaagtttgatcatctgaaaccttcttctctcagctcatcaaagtcattctccgtccagctttgttctgttgctggtgaggagctgcattcctcagctggaaatgcagaaatcacctgtcttctgcgtcgctcactctgggagctgtagactggagctgttcctattcagccatctttgaaccaccctcccactgtctttaaatattgacagaacgctttgaagataggcagacaccccagatggaggctgtgagtccctgcaccaagtcagtgtttctgctcctcaagtgcattcctgtcttattttgtctaatacaaacagctctattagtgggaggtgtttcatgatggaaaaaaagggctgaaatggcttcagcaagggggtttagagttaaagaatgttattgaaatatgcagttttatgtcatctactggttttaaaaaattgcacatatactctggatagaagttttcatttccgttttacaaagtttagggcttttttccaaaagacagacttccagaacaaaacaggggaatttacccagctctggccaaagagccctaaaggatagatatcttttcatgtcaatagctggaggttttgcttaaaagagaggttctaaactcagagggccaatcttaggctttcgtgaatctaagacatctccaaacccttctgggtgcctctcgctgagcccagccaccctggggacacctgggcattccctgtgtctcctgatgtcttctgtggtgctcagatctgtgcattcacccaggactttcctgacaacctgtactgtgggatcaggtttgtttcccatgcattggccttgaactgggtatgttttcttgtgtgggaggcaaataactgcttatttattcaagaattacttttaaaaggtatagatggttattaagtcattttgttacatcaatcattagttggaaccataactttcctgggagagaaattttcgatgcatgctattaatcttggacttttaagcggtgttttccttgtgtgtatttctataagtcttatatacgtgtttcttttatttttattttactttaagttctgggttacatgtgcagaatgtgcaggcttgttacatagaactacatgtgtcatggtttttgttgcacctatctacccaatgtctagtttttaagccccgtatgcattaggtatttgttctaatgctctccctccccttgcccccaaccccgcaacaggccccggtccatgatgttcccctccctgtgtccttgtgttgtcattgtttaactcccacttatgagtgtgaacatgtggtgtttggttttctgttcttgtgttaatttgctgagaatgatggtttccagcttcatccatgtccctgcaaaggaaatgaactcatcctttattccatggtgtgtatgtgccacattttctttatccagtctatcattgatgggcatttgggttggttccaagtgtttgctatgtttattatatacgtatttcaatgatcacactgagtttgatagaaatggacagtcatctttaagatatggaacttgattcatatactctacccacatgtgtgtgcgtggtcccacaacacacaagctcacggcaaccttcttaggaaaagtttccatatatccgtgtatatgattttaatggtaagggagaacatgtgtaccattcggatatatttaagatctatatgcttctgagatataaaatttttcaggcaatttatgaaattaaatacaatataacatgtaataatttctacataactaatgttagcatttatcgggtgcctgtggcgtgtccagcatggtgcttggtatataagttttcatctagttttgacaacaatcctgcctggcgggcggccacccacctccacctgctcttcagaaaagaatacagcttaggaacttgccccagggccacagagttggtaaatacttagggccagggatcaaaactgtacatgtctgaccccaaggttagtatttacttcaacacataatgcagtatggacaaacgaggagaagactataaaattgagcagaagaaaataaacaatttacctattctaggtataatagtatcttataacaagcatttataaacacacatgcatatatttaattaagagatacaggtgctaatcaaatgatgacttcctatgcctatatttgtcataaatgataagatactaaggccaaaccagtaaactattacagagtctctgactgggaagatggcaggcctgggctgagaaaataatactcaggtacattactctccaatgatgggacagtgctgagagagaacttcagcaagacagaatcatgagaagtagcgttagtctagaaaatttgcataaggtggaaatgccaccagcttagtcaactctggctgctataacaaaatatcatagactgggcagcttaaacaacagacatatatttctcacagttttgagactggaagtccaagatcaaggtgcttatagattcagagtcttgcaaggacccgtttcctggtttgcagatggcatcttctaattgtgtccttgagtggcagagaacaccctggtttcctcctttccttataagggtgctaatctcatcatggggtatcaaccctcgtgtctgcatgtaaaccaaatcacttcctgaaagcatcacttccaaacaccatctcattggagattggggcttcaacatatgaattttggtgggacacaaatattcagtccattgcaatcaccttctcttggatttttggtctttccatccagaagacttcctttgttcattagcaaacaaaacaagatagcatatccaagcccacattgctgaggccttactatggaggctacatggatagcaatgacatgttagacagtggagacgtgaggatgtgcatagtgctgccaaccctccaggagcaggggaatggcacgcacatgccagccaggtcaatgaagaccaacaggtgctgcaaggagaacaggtgtggtcaggccttctgtgaggagaaaaggagccactagtggggaaagacatgtggagaaagtggcacttgagccatgatgggaaagtggtgaggggaggccactgcatctcttcaagatggcgttttatggtcgacggtattcgtcaggtttccaaaaggtggatattaatacatccacctaaatccctgcatcactgggcattaaaaaccttccagggagactgatgttaacccctttttgtgcctgtttatgtttttggcctacagaggcttagggggtgacgtgttgcataagttcattatcttccaggatataaacaagtcttacgttgtccatcctttttcaaatttaaaggatagtctttactgcaaagtgccctgataacttcagtgcagcctcatttggaattggtttcacctctttgaaaactatagttacctttcattttttgaagagtgaagttgggatgaagggcagggacttggaatcagcaagactggggctctcatctcattctctgcctctgctggttatatggctagaaaaatcaagtcctttttgactcagttttattatctgtaaaataaggatattaatatctagaatctggagttataatatattttgcagtagcttaatgtagtacatgatacatagtaagcatttaattaataatattgttaaattatctaatgattcacggtatactgtccaatacttttaagagtagtgatcattttttgtttataataataatgataatagccatggtggtattttctatttaaatattcttgatttgaatgagaaatgcttaggaaattatggcttctacttagctcgtgatgataatttgttaatcttcagattataggatattttacatggtaagttcaaagaatgtggtattttgggtgatttattaatttgcaataaagcaacatgggttacagtcaactaacaaaatgaagtcaaccataatacaatctgcttttgataattctagagacaactcagggtcttgtattttctcgaagtcttcattatgaatgttgctcaacattgacaaatggacagtttctagggagattttttttgtcttttgagagggagtctcactctgtcactcaagctggagtgcaatgacattatcatggctcattgcaacctctgcctcccaggctcaagttattctcccacagtggctgggaccacaggcatgtgccaccatgcctggctaatttttgtatttggattagagacatgattgtgccatgttgcccaggctcgtctgaaactgctgagctcaagcattctgcctgccttggcctcccaaagtgctaggattacaggggtgagccaccatgcctggccctccagagagttcctaatgatggcgtgttgcactccagtgcccacagtgtaggtttgcaccttcatgctttcatgcttgagggaatagctccaatagtttcgtggactaaaatgcagtgctcatatcatgcagcaagccagctgattgggtgtaagttaaaaatagctcacaccgtaaatgctttatatataagttgcccgcacccgttaggtcaaacaggctgagttattcaagttaaaattagctctgaatcaagtatgtgcatactgagagggtaggctctttgtgaaatattgaagatgcaaacactttctcctgtaaaatgtttatgaacatcacagttgagtaggttgttaaacacattcttgcttgtcataagtcagggccacattgtacccagagaccaaggggagttgatgctacgtcttcaaatactttcatctccatattcttgctaattttccaatactgaatcatgaaattgcaattcttttgttcagtacttgctgaattttcagtttacctgttaagcaggcttgtagaggatacggatttgagaaaaagaggacaaagagcatgtgttcaatagaaacgaatttggaaatgtttattgtggttcatgcacaggggcatatgtggttgaataatttcagattctgtgtcccattaatgacatagcatcagagtttcctttaatatcttcctactctgtattaattgattcatttattattaactcagtaagcatttattgaacatttacagtatatcaatcataccgctaaatgctcactttctagagatgaaatgaaccttaaacaaggaaagcatggtatgtgttacaacacaagtacttacaataaggcataggaataacgagataagttattgattctccttggggtgaagagcttggaaaaggctttttaagatagaaaaaccatggattttcatggattgaaaaacctgaaggaggagtagaagctgcgtctccaagtctattgcccatggtaatgtgctgctggaaaatgtttagcaaagggttctcccaggagaagagcctgatatgcagccttcttccatttgcctggtttaaatacatccaccatggccaatttcaaaccaccaccatgcccatcactggagacagccttgggaacagatgcccagtgacactgcaccatgtcatactctgaccggatgaaaaagtaaataccttcaagagtagacaatggccaaatgtaaacacattattgggaatccatgagctttaaaccattattacctctgttttaatataattgatttcttgtaaagtttatataatctaaatatttaaaactgaaatagcagcagacctacacgtgttttgaacatttgaaagtcagctcccacactctgataccagcacaccctggactgtttatgttttctgagctgtggttgagaatgcaagagtgggttctaaatgccgacacacactacaactgaaaaaggggaaggtcagaagccattgggagaaccttaggattctcagactatttcttaatttatggttaagactctttggtttaatataatgtgtaagttttaaaaaatcttatgagcaaataacaaatcaggccatactcagtcaatttcatcaaacttataagatccctgaccataaagagatttcacactagaaaacaagtttgcaagaggaagtagacagcacctaaccttgaacgctgcatcaaccttttagaatgatacactttgaaagtaagataagatgttgactttgttaatttgcttcttcatttaaataaaacctactgtcttttgtgttctcaattatttttgtttaagtattgcaacatatcgaaactaaaaatgtgtggtcgaaaactttctttcaaaaatgaccagcaggctaacgacacaggacagaggaaatgagggtgggtgccccatctcccagtgatagaggtggtgacaggtgagtgggcctgctttcaagtcattgctcaagaactgaagttctaggctccaagcccagggctgctctttccaatttaacagcacctgagcaaggggcctgttttgtgtcccaggcagcctgccggtgctgggcatgcaacacgaataagatgaagaggctcccaaggagctcacagcaccttaaagcaaggcagaggcttgtgaagcctaaatagatggtatattagtcagggttatctaaagagatagaactaatcatatatatatatatatatatatatatatatatatgatcatatatatgatcatatatatatatatatgatcatatatatgatcatatatatatatatatgatcatatatatgagtatatatatgattatatgtgtatgattatatatatgattatatgtgactatatatatagtactgttaggatgtatttaagatctatatgcttctgagatataaaagttttcaggcaatttatgaaattaaatacaatacagcatgtaataatttccacataactaatgttagcatttatcaggtgcctgtgatgtgtccaggcacatcatatatatatatatacatatatatatcccacacatatatatcccatatacatacatcccctatacatagatcccatatacctatatataccatatacatatatatctcatatacatatatatcccatatacatatatcccatacatatatatcccatatacatatatatcccatacatatatatcccttatatgtatatatcccatatacatatatatcctatatacatatatatcccatatgcatatatcccatatacatatatatcccatacatatatatcccatatacatatatatcccatatacatatatcccatacacatatacccatacatatatatcccatatacatatatatcccatatacatatatatcacatacatatatatcccatatacatatatatcccatacatatatatcccatatacatatatatcccctatacatatatcccatatacatatatatcccatatacatgtatatcccgtatacttatatatcccatacatatatatcccatatacatacatcccatacatgtatatcccatatacatatatatcccatatacatatatcccatacatatataaccatgtacatatatcccatgtatatatccttcatatataaatatcccatatatatatccccatatatatgtgcaatatatatatccccatatatatcccatatatatatatcgcatatatatatgggatatatgtatatgggatatatgtatataggatatatatatatatatgggatatatatacgggatatatatatatgggatacatatatatgggatatttatatatatataaaggggagtttattaggttttaactcacatgttcacaaggtccgacaataggccatctgcaaactgaggagcaaggagagccagcccgagtcccaaaacagaagaacttggagtctgatgctggagggcaggaagcatccggcacaggagaaggatgtaggctgggaggctaggccagtctgaccttttcatatttttccgcctgctttgtattctctggcagctgattagagggtacccacccagattaagtgtaagtctgccttccctgatccattgactcaaatattaatctcctttggcatcaccctcagagacacacccaggatcaacactttgcatcctttaatccaatcaagttgacactcagtattaaccatcacaaattgtgagaccctaggaacatttcactgccttttacataacttatttagaaatgtatgcaattgcacctgatagcttaaaataataaggtataaattatatccttgggtgtgttatttaaagtctcaaacatcttcatttcctcaaatgttaagaaagaagaaggaaggaggtgcttgatcatcacctgggcccctcctgttcatggctgacatcacccactgtgtcctgttctctgaattggctgttagggctgcacgtggatccctgagggctctgatgagtgtgtgtagcctcaggcttagccaggtcagggcccctgtcctcctggccttcctctttgtacccagttcctagcataacgcctcacacagaataggtgctgagctaacatctgttgagttaataaatgatgtacccagcgggcgaatacccagcttgtcttccctgtcgtgattttctgtccggaagagtctcattcaggctacattcccctccttctgaaaacctgaggtttctccattcaagattcattaacttgggacttgtattctcaatatttagtagaggatatctaattactgatgttgaatgaatgaatgaacaggaccatcagtggagtccctcactacagtgtaaacacgaacccctagactggccagcccaagaagctcaaggccttggaccctcccgcccaaggcaggctctgaagcatgggcctgagaaggaaataattgctcacacaaacaggcaacacaatgacaaaatgacagatgagaaaacacagatgagacattttcactcagattgatgcagtgtgctaccttatttagtgtctttgaatttatgctcctagcctttcaattaaaacataactttatgctcatttgtacgtgctttccttgttttaaccattctgcccttgagggataattaactaatttttctgtacgttaatggcttccacaatcatatttctagtggggtcgttccttagttttgaagacaggttaaggtaaactctaaaggtataacgtctgtttaatgaaagatttccagtgaaagcacaggctaacctggttgctcaatgatttctccccatctttcctgtttctgtcacgcctctcaaagagctatggctgaggggatgtaggcgttgctttgccacccgcattaaggctgatagccaccagagcaatataattctataattgtgttcattctataactttacttaacagcaaattgtctaaggcaacaaaatgagccaaaactagagtagatacaggatgttcagtatgggtcttccctagcgttggcccctcctgagctcccaactcatccatctctgtgtctagacttcgactcctggttgatctctggacacctcagactgagcttctatattgcacactctgttcaggatcgtctcttctccccagggcttcgtctcttttgcatattttctgtagtaaggaccaggcttgatcccctttgcatattacctgtggtaaggaataggaccaaggtgtacaatgcccagtcagacaaactctctccgttctccttgtaatatcccccaaactctatcatctctccacctgaataaaccctcatctcttcagcttacactgtagctacctgagttatcttaaaaatacatatttaaaacagaatttgggtctggggactccatccgtcatgcacagcccagggcctgtgtgggacatgcccctccttcctaatcctctcacttcatatcttcctttacacagggccatcttcgcaggctgaactcatcacccagaatgagatccagcagtggtggacggatgtcagttttactatgttcccttattagctgggaaacatatctcagaggtcagcccctctgcacacccctgtagattcgttatctgtccaaattgtgttcaacgctctctccccattgccttctagcccaggggtagaatgactgcacctgattgagactgagcaaggctcatccttgggatggggactgggggagaagccagcttgctctgaggcgcacagacactcatattgatcgggattggggctctgttagaaagacgcagggaggaaatgggtgggtgaattggcaccagtggtgtctccgcaacatacagagtctttgatgatctggccttggctgcttctactcactgctatttcacgattaaacatacagacactccaggatgcctgctgttcatgaatttgccctgggtcttctgtttccatgattttccgcaagacacttgctccctgaaggttgcttttcagaactcttgtttactttctctaatgagtaactactaatcctctaacagctcaattcagtcatcaccatgcgtggacaactgctcttcaccccaaggcctgggtttccagagcaacccaaataaggaggaggactcctctgtcactcacaaaatcatctcaggtgtttatgttgtctccaaggactttctcagcctagtcctcacgtccttcctgacctcatcccaacagctcccatcccctagttggctccagccaccctggccctgcattgtttgccagggctgtagtgccccaaggccttgccaatggctgctatccaaaatctcttccccaagatctccacacacctcaattttcactcctccgagacctttctcaaatgtcatctccatgacatcctacacaaggggacacctgccaccccttcactctctttttatctttccttatttttcacataacccttataatctgacatatcataaaacctattaatatatattaatataatgtagggactatgattatataatgtgtaaatgtttataaatgtttgcacatttgtcttatcattagaatgtgagctccataagaacagcccccctttacctcactcccaaactggtgtatccctaatgcctacaagattgccttgcttgtaccaagcactcaataatcatttagagaatgaaggaatgaaaggatctgagcatacttctagcttggcgccttcagggttgtgccatagttatctttctgctaaaattcgagctcttacaattagactgcaatgcttttatttctctatctcttacacctggtaaatcatgtgcaccatagcaggtgtaatagttcattttcatgctgctgataaagacctatctgagactgagtaatttgtaaagaaaaagagatttaatggactcacagttccacatggctgaggaggcctcacaatcatgatggaaggctaaaggcacatcttacatggaggcatagaagacagaatgagagccaagccaaaggggtttccccttataaagacatcagattgcatgagacttattcactaccatgagaacagtatgggggaaactgcccccatgattcaattatctccctctgggtccctctcacaacacatgggagttatgggagctacaattcaagatgagatttgggtggggacacagccaaaccatatcaggcagctttcaaaaaaggcttgttgaaagaatagatgatgtgtagatcctggccctgtgcatgttaacagcaaggatcaatcgtgattcagtatttctgtcttaattattttagcaagtatacattaaaatcagatattttcaaatttttaatcaattacttgaactctactgaatatgtcattttaaacggacaggcgtttatatcatttaagttgcttttgaagcatattcttcacatcggttctcacaatctatagactaaagaaaagataagacctgtgaggaatagaaatggaaagtctcaccagtgtggtggggaaaacaatgagaaaaacaaagcatcaagccaagcgtggtggctcatgcctgtaatcccagcatttggggaggccagggcatgtagatcacttgaggtcagaagttcaagaccagcctggccaacatggtgaaacactgtctctactacagatacaaaaattagccaggtgtggtgttgggcacctgtaatcccacctactccgtggaggctgaggcaggaggaggctaaggcaggaaaatcacttgaatctggcaggtggaggttgcagtgagctgaggccactccactgcactccagcctgggtgacagagtgcgactccatctcaaaaaaacaaaacaacaacaaaaaagcaaaccaacactgaggtcataaatgcaggagcctaagccttgggttgatcattcaagagattcctaggggtgctctaagaaatagcctcagcttcaagctactgccttggataaacaccttcctatattttaatgactttaattcatttgagataagatatgtagcgatggtttcacatttcctgagttttatctttctgtttgtcccattaagtggaatttttcaatatttctctcagggattatttagaaccctactgagtcaattacttggttaatattaagtgggatagtaaggaatcaagatactaattattttcctgacaaatatatatatctttgagatggagtctcgctctgtcgcccaggctggagtgcagtggcgtgatcttggctcactgcaacctccgtctcccgggttcaagcaattcttgtgcctcagcctccggagtagctggtattactggtgcatgccaccacacctggctaatttttgtattttagtagagatggggtgttgccgtatgggccaggctggtctcgaactcctgacctcaggccatccgcccacctcagcctcctaaagtgctgggattacaggaattacagatgtgagccactgtgcctggctgacaaattatattttatttagcaaaacaatatatcagtaaaagatgcaaatacctaatattgttccagtaattttatctcattggtcaatgctcatgatacaaaattcctaatcacctgaaactttcttattataagcattgttaacctcttaggttatggatgtttcttgaatgtcatggaaacatcagagaaattggtagtttatgtataattatgttattttacattaataatatatatcaaatatacatataaaataggaaagtcacttttaaagaatgtattgaaatctttgacgcacagagacaaaatgaaaccctgagaaattgtgatgtattttttggaatttgtgacgttgaaattctgtctgaattgtttatgatgtctggctttactgctaaacttttagctattttaatgttgactctcttgatagctttgtgtacagttttaccagtgtcaggatgtactctttattttcaatgttaacctggacatcttcattagatatttttattcaacatcccgataagatgatgggccagctcttttcagcttcttgatgcaaaagcaatgagaaaagatgctcctgatcttggcggagcctttgaaatggtggggagacagacagaataatacaaggcagaggaaaactcctcagtctctttgcttttctctcatgaggaaacactcacgctcttgacccaccatcagcatacaatcctggaggatattttacatattctatgcatgattaacattgagctgcctatgctttctgagcaatttccattttgcccagaataacatggttttggaagagaactgattcaggttattgaagtgaaccaggagcagaaaaagcttcattgtatgaagtccaatattttaattttaagatgaagctggaaaacatcattctgagcaaacagttgcaaggacagaaaaccaaacaccgcatgttctctctcataggtgggaattgaacaatgagaacacttgaacacagagtgggggaacatcacacacaggggcctgtagtggggtgggggtctagggtagggatagtattaggggaaatacctaatgttaaatgacgagtcaatgggtgcagcaaaccaacatggcacatgtgtacatatgtaacaaacgtgcacattgtgcacatgtaccctagaacttaaagtttaataataataacaaaatttaagattaagaactttaactcaagccatccaatggctgaagatttacaataagatttagtaatgtttgaacaaagccttggttctgtgaaccccaaatatctgaaacatgactcagttaatttagaaagtttatttatccaaggttgaggttgcgcctgtgacacaacctcagaagatcctgataacacgtgcccccggtggtcagagtatagtttggctttacacattttagggagacatgagacatcaatcagcatatgtgaggtgaacgttggttcggtccagaaaggcaggacaactcaaagcaaaggcgggcagaacggctggaagcagagaaggggtttccagttcataggtagaaaagaggcaaatgattgcattcttttgagtttctgattagtctttccaaaggaggcaatcagatatgggtttatctcagtgagcagaggggtggctttgaatagagttggaggcaggttggccgtaagcagtttccagcttgacttttccctgtagctcagtgattttggggccctgaggttcattttcctttcacagtccctatggctatcaaatcgatgtctgaatctctcagttctcttgagtccttcctgtccacatgtcttaaaagcagtcagggaaatttacagaagtgcccctttataaagtcaaacttgccatgttccaaacagaacgcaccatgcctacctctgaaaaatatattctactgcccacatcccacccctgtctgtcagtagtatcagcactctctcactttcatggagaacggcctcttcaactctttgtttaaaaatatctttgttgttcacgctttctctgtgctggaaatgaaaatgcaccagcctttcttcctaaccttttctttgtcggcctctcctgaggcccccactgcttcaggtcttcattgcgggcagttctgtggggctctgattttgctgacatctgcattttcctttattcccactgccagacaaatggcatggagtctttatttatttatttattttactttaagttctgggatacttgtgcagaacctgcaggtttgttacataggaacacatgtgccatggtggtttgctgcacctatcaacccatcatctaggttttaagcctctcatgcattacatatttgtcctaatgctctcccccctctttccccctacccaccgacaggccctggtgtgtgatgttcccctccctgtgtccatgtgttctcattgttcaaccccacttatgagtgagaacatgcggggtttggttttctgttcctgtgtcagtttgctgagaatgatggcttccagcttcatccatgtccctgcaaaggacatgaactgattgttcttcatggctgcataaaaaatggtgtattcaaccattctggaagacagtgtggagattcttcaaggatgtagaaccagaaacaccatttgacctagcgatcccattactgggtatatagccaaaaggattttaagtcattctactataaagacacatgcacacatatgtttattgcagcactatttacaataaccaagacttggaaccaacccaaatgcccatcaataatagactggataaagaaaatgtggcatggagtcttgacattcatatatttaagttagggagagatggaaaggagaggaggagtggggagagagagattttaagaaaccatttaactgtttacaacatttatagttcattttactcactagtgacaatgagaaagaaaataaaaatgctcccatctgggattgagcatagttgaacatactgtgttttcctaaacccactgttaattcaagggtagttttgtatgtttacaccttttccttggtgagctatctctatagcctaaatcttttgtgaagataaaacatcctggtgttccactaatgtccctttaagcatgctccttctctgtttctacacaactactgagcagttgcctttcatgttttctacgacttcgagtaaaaatcccccgcttcttccatcaaggtctgcgtagctcctctctcccgcagcctctgggtgtcccgttctcattttctctcttccctcaatcttactcctctttgctataaatttgctgtcttcttccatcttcctgtacaaatcctatgtgtcgtccttcaacaccgatctaaagggtggcttgtttggtgtgataaaaacttcatctgaattaaatttaaaggagtttgccggtcatggtggctcaggcctgtcaccccagcactttgggaagccagggcgggtgaatcacttgaggtcaggagttcgagactagcctgaccaacatggtgaaatcccgtctctactaaaaatacaaaaattagctgggcgagatggtggatacctgtaatgccaactacttgggaggctgaggcgggagaatcacttgaacccgggaggtggaggtttccgtgagccgagattgtgccaccgcactgcagcctgggtgataaagtgggactcagtctcaaaaaagaaaaaaaaatcagtttaattgagcaatgaacatttcgcaagtcaggcaacccctagaatcacagcagattcagagagcctcagcacagccacgtggtggaagaagatttatacacaaaaaaagggaagtaacatacagaaatctgcagtgaggtggagaaacagctggattggttgcaggttggcatttgccttgtttgagcacagtttgaacgctcagcagggtataaatggttgaagtatggctgctgggactggccaaggctgagctcttgttacagatgcatactcgtaaattaggttctcaatcttgtctgcctgttcagttagttgcaattcatccacaaggagtcatatacgaaagtacggagttctcctcaggctatatttagtttgctttaacagatggaacccggctgtatcctagcatttgttttctccttctctgagcatttcaaggcttagcggtggcaggaagcatccgcataccaaatagcagttgacgctgggtgctggcgctcacctctgccaatccctcacctctgcttcacacctgtcagtcttgtgtgtgcaggaactcaagaaacttctatgaattgggagcagctgtgtatacaaaaaatctgtcatagagtctgaacaattgaattccaaatctgatctaatcctcatgagttaagaaaaagtcagtcgggcggggtggctcacgcctgtgattccagcactttgagaggccgaggtgtgtggatcatttgaggtcaggagtttgacatcaccctgaccaacatggtgaaaccctgtctctactaaaaatataaaaattagccaggtgtggtggagggaccctgtaatcccagctactcaggaggctgaggtaggagaatcgcttgaacctgggaggtggagggtgcagtgagctgagattgcaccactgcactcttgcctggactgcagggccttgttttttttcaaaaaaaaaaaaaaaaaaaaaaaaaaaaaaaaaaaaaaaaaaaaaaaaaaaaaaaaaagccacttgatctgagccctagtttacatataaattcttactcctgtgtttgcttggatgatcaaacaacaataagaaatgccaacatacgtggattactttttctgtgctggtccctgggaagatcgctaatactttcagtcctgtcaataatcctgtaaggtggacacagttaccatcccgcttcacagataaggtcatggaaaaacataggcaaagaatgtatacaagatcccacagacagtaaatagcagaggcttcaaatgtagataattgcgggctcccaaacccacactctaaaccactgcagtataatagcctctcattacaaatgaaataatgtagttgaaagtattttgcaaactataaaatgtcagccacatacatcacgatggtaccttatttctattttatacttcatagcgtgttgctgaacacagggacagtacagaatgaagcttggcgattagatacgtattgttcagaacgagcagtgtgtgagttggatttcttcttaaaagtttgaaattattgcaattcttttagattacacaatgaagatatgctctttcttggaaatttcatcttcatagtttagatttatatggcattatttctctaaagaagttgaaattgtatagtctatttgggaatgtcattttatgccgaatggttttacttcccagttctattgcgtattgggaattcaagatctttaccagtatttttcataggggtgttgggggaattaatattatggagtgtagaactgatttgagcttgtttggaaagcccatattgttaacagaaacagcagtattttcttgttatctgctttgccacatcaccactacccttctcctctagtgggaaatcccaaagggaccaattcacagttgaatcatttttgctaatatgataaccccccgaaaaaaagaactaggatcatcccaggacagctggcaaagagaataacagtttgaccttggctaagtgaaacgcatctgcttctgtgtttcggagatttgaaaactaagtagtgtctcagataattatacaatgattctaaacactgagacccgttacctgtgtctaagtgaaaaatttcatcagtgggtagtaaactagattggcaagtgcaaaatgaaaatttgtttctttgtaacaataactacacaatttgtcaagaaggtgatcatctctgcaatttggtagtctttgttatcatgttctcataggaataaatatacacaatttcacctccctgggcttcccttgccttgccgtagaatacaattttgcttcgtagaaatgattccatgaatctgcaacaagttacattttattttaaggatttatgtgctatctatgtaaattgttctgaaataattagattaccatttcggaaattagaactaatttcaagtagatgcaatggcgccgtgttaattaaatgacactgctctgaggacctagaagtattttagaagaacacactacaaatattaggtcattcctagcatatgaaagttatattttaaatatgcattatttggtaggtcaagaatggaattattaattgaaatggcaaaacagaaggcattcgaaacatcccctggaattaggagaaaaccttcaatgttattaaccataattcaaacaaaattgttggaagactttatttttatttttattttttgaggtggagtctctctttgtcacccaggctgaagttcagtggcacgatcttggctcactgcaaccttagcctcctgcgttcaagtgtttcccctgcctcagcctcctgagtagctgggattacaggcacgcaccaccacgcccaactgatttttgtatttttagtagagatggggttttgtcatgttggccaagctggtctcaaactcctgacctcaagtcatccacctgccttggcctcccaaagtgctgggattacaggcatgagacaccaagcccgaccaaggaaagctttaaattaaatatatatatatatacacaatatatatattatagatatatgtgcttgctcattaaaacaaaacattactaacatttacttttaagattgggatgatttacaaataaaaagagtaattcttattacaaagatgtatttaaagttgagtagtgatttaagtaaatctatatgctaaatccattgtttatacacaaatacaatcattgataagaaaaaaatacatttcactcccatgcctattccatgtatttatcttttattttacattgagagtcatatttgaatacagtttacatagaaaattgtatcttctggagttacattctgagagagataagctgctgaagtttttgagttggttttttatttgatgataataatgttgctagcattgtgataatcagtgctgaatgcctctgggctgacgctgttatgctctgagtatttcaagacgagaaatccagttttccttctccaaatcccaaacttctctttatagaatatatttgatgtatttaccattaatcaacaatgatgtaaggtccctccccatcagaaaaaggaaaaagaaaaatttgcacagaagctccagggtaagtttcaagaggatttttgtttatagtttctcttttattattattatacttcaagttctggggtacatgtgcagaatgtgcatgtttgttacatagttatacacgtgccatggtggtttgctgtgcccatcaacccatcatctacattaggtatttctcctaatgctacccctcccctagccccctacccactgacaggccctggtgtgtgatgttcccttccttgtgtccatgtgttctcattgttcaacacccacttatgagtgagaatatgcagtgtttggttttttgttcttgagttagtttgctgagaatgatggtttccagcatcatccatgtccctgcaaaggacatgaactcacccttttttatggctgcatagtattccatcgtgtatatgtgacacattttctttatccagtctatcattgatgggcatttgggttggttccaagtcattttcttagtttgcacctgctgcctgagacctttgataccatacagttttatagtttcattgcagagatcttttacttcttggtgaggtatattcttaggtatcttattttatttgtagctattgtaaatgggactggtttttcttttcagattgttcactgttggcatatagaaatgctgctgcttttgtatgttgattataccccaaggcataatgaaatgatgtaaacatagatcctgcagcatcttcctgtaggatgtaaatttacttttttttgtagccaaatgctagggacagatgatgccatattctccaatgacaatgtccagtgcagcaactcggtagtggactctctccagaagaaaagtttatcccaaaaatgccctggcagacactttcctgtatgtctcattggccatgagtgggtcacatccccatgtcctaaaattcactgattggcttgcaaagtgagtctctgatttttaaaggctttttttttttttagacagagtcttgctctgttgcccaggctggagtgcagtggtgtgatcttggctcactgccacctctgccacccagggacaagctattcatctgcctcagcctcctgaatagctgggactacagggatgcccaccacatctgcctaatttttggatttttagtagagatggggtttcgccatgttagccaggctggtctcggactgctgaccttgtgatctgcctgcctcagcctcccaaagtgctgggattacaggcgtgagccaccacgcctggcctaaagcctttgtaatagaaagacagctgcaccagcaaggaagaaaggagagtaaagggcttcgtaagaaaactcctctcccatctcatgttctcatttgagcatctacccattattttgcggattagaagactgaggactgcactattgcataatgaatgcttcagatgcagatttctgtccaccaaacaccatcttttcactctcacaaagataagaaatgctgtgtataggtgatgcactgagaggaaaaaaaaagagaaagcaggtgtcatctatcaaataaacagccgcgctggaaagcttttctaggaaagtagtgctatacctttcgccctaagcttctgagagagtatttctgtgttgagtaaactcacgtttgactttctcctttccttcctgtttacctgggtccctcacatggttatgtctaacagcggcttctgaatagctctggtaggaaacattctcacttgagctgtacatacagcccttcctaaagaggctttcgccccaatgagttcactgcgcaccccatgatcttctggtagcatctgtgtgtagcaggggtgctgggcattatttgaaatatatctcatgttatttcccccagagagatgtccatctttgcagaataaaacttatttcaccaaccctttcagtgaaaggggttctgagccaggtgggacaggaatcagagtctctggagggctccagtcctgctcttcattcctggcatcacaaggattaaggtcttgcatgttctattctttccaaagatgaagtctgacaggttttccgtcaactagtctttgcatcagtcctgaaaatattggaagactttctttcttgctattagactctacctttcctgcctcctacagccgtagctaatttcccaatgagcatgtttgtgctgaattataaatcatttagaatgggtggatatacagcagtggaagattaaaaaaaaaaaaaaaaaaaaaacgcaacctccattgagtcatcttgtaggctcagctggcttgcagccctgcctgaggggcctggtgggacgggcattcatcagtgggggttctctcttggtaccttacacagttgggtttcccagcaggtgcactgtgcagtggtcctgagctggctgtgtttatgccaaacctatttctgatactattgtttgtcattataattatgtagagtaatgaaatatgctataaactaattaaatgttatcttaaaagagttactgtgactagagtaatagtgaaaaatgaaaatcactgccaaattcgctgtagggaagatgacagtaaacaatgtgggaattatttttaagaaattgaaggatcatgcacaaagatagccttcatgttcatgggtcttaaattcttgccttgttttgtagtaaccaaaaccttgacgttttagatgatcattaaaagttggttttgaccaaaaaataatctgtgttccctgtggaacaaagtcaaaagcaagagatttagctctatagctaaagcttggaaaattaatgtgtattttcatattttgaatgaaaataaattggttaaaaaacattctttaaattatttccctctttaactgatatattttaattaaatttaaaaatttgagcgttattgctgtctccctttcttcacacctggcattttcagtttgagatgcatcaggctccaaaaagcaggaagtgccagatgagatgctccctggctcaactgtgtggagcccagctcctgtctcccagtctgttgcagagctggcaggtccgggtgtgggtagagcaggtgatgtgttctatggatcctgggcgccatggtagccctgaggcagctggtagacccagtgggagcacccagtcctaccccgttcagctcaagccctggagcacttcatcacctgcagagatgcccaatgtgtccctgtgctggctctgacccgaatctcagccagtcttacttagcatatcacaaatggagctctcacacctagcaaatcaaaggctgccctgctttgaaaaagatatgggaggtctttgagtatgtagacaattttttcttctcctaaactctccgtataatcatgacaatttcttatttgtaagttctcctaacagtgtggatttaggtatctctcctcttgatttttaaaagctcctgtgtaccctcttcctgtaccattatcttttccctatgtgcacaggcatgtggactacaccaaagggtactttacatctctgctatttatacgcagtctaaaactaactgatttcaatgtgacatcaaacttttcaaactctagtatgaattattacataattttataaatctttgtatttctattgtacttaaattttggctaagaatgtcattttaaataagtccctgaaaaccaaggtttacatacaattcagtcaaactgaaggtaaatattaaaacactgctgagaatgatgtcttcagtgatgtgtgtgtgcacacagggtgtcctgtgaagatgaggggtggttacactgtttcctgacaacaccctctactctaacagaaaagagacgttattacagtgatttctgcctaattggatgttatacagttggcccctccaagcagtgacatttgcttttcacatcaatgatccaagttcaaatcacattttctatgtgacaacagtaggctgtcatgggtgaaatgaaacttgtcagtttcagacacaagagcaagtgctgatttttaatactgatgctgtcaggattaagacagtcatttctgggaatgtaaatgaagataaatatatatatttaaatctatcaaatatgtattggtcattaaacttgtgtcacgagttagggatatgtcattttggggacccactgtgtaacagccatgcgatgtggccggtccttcactagagtcctcattcctcaaaggaggcttccacaagtgccaggacttgggctgtaaaaagctggcccttatcaggcttcgtggcctaaaggaggaatgatttagaatccccataactggccaggcagggtggctcacacctgaaatcccagcactttgggaggctgaggtgcgctgattacttgaggtcaggagttcgagaccagcttggccaacatggtgaaaccctatctctattaaaaatatgaaaaatagccgggtgtggtgttgggcacctataatcccagctactggggaggctgaggcaggacaatcgtttgaatccaggaggcggaggttgcaatgagccgagatcatgcctctgcagtacagcccggacaacaaaagtgaatctcaaaacaacaacaacaacaaaagaacccccataactttagttttctttaatttttttccagccatccctaacttatctatttgatatttatatgagacaatgtaaaaaataagaaaagtttggaaataattacaattttaaatatatttgtatatttatatatttaaaaatatatgcaacttgaaaaaatttgaatttatagggctttcaattaataaagcatatgcatggaggctggaagcatgacgttgatgaatgagtctttactgagtgctgttttctgatagaaaacatttgtgtcttttattggcttctagtataatttgagtggcattaatagtgcagacaatgctaattatacttgaaagcagtcaggagaaaataaggggctttcagtctttagtggtgttcatttattcattcgtttattcattcattaaatatgtattgagtgctgactgtgtgcaccctctgttctaggttctgccaatacggtagtgagcaaaacaaagtcttgcccccaggactttatattccaggtatatgtttgggctgttttcccagccaaatctcaccttgaactgtaataatccccacttgttaggggcggggtcacttggagataattgaatcacatgggcagtttcccccatactgttcctatggtagtgaataagtctcacgagatctgatggttccataaatgggagctcccttgcgcgagctcttttgcctgtcaccgtgtacgacatgcctttgcttctcctttgcattctgccaagattgtgaggcctccccagccatgctgaaatgtgagtccattaatccgcttcctttataaaatacccagtctcaggtatgtctttattagcagcaagagaatgagctaatgcatccattgtgtttgggaaggagacagaaacaaacaagtcaacgtatttgtgatggtgctaagcgctctgatggtggtaagcatgctgatggtggtaagcacgctgatggtggtgagcactccgatggtggttaagcatgctgacagtggtaagctgatggtggtaagcgcactgatggtggtaagtgcaatgacgttggtaggcgctctggtggtgatggcgctctgatggtggtaggcccgctgaaggtggtaggtgttctgatggtggtaagcgctctgatggtggtaagcgctctgatggtggtaagcgctctgatggtaagcgtgctgatggtggtaggtgctctgatggtggtaagcgctctgatgggggtaagtgcgatggtggtgggtgctgtgatggtagtaagtgctctgatggtggtaagcgcactgatggtatgtgtaatgatgttggtaggcgctctggtggtgatggcgctctgatggtggtaggcccactgatggtggtaggtgctctgatgatggtaagcactctgatggtagtaagcattctgatggtggtaagtgtgctcatggtggtaagtgcgatggtgggtgctctgatggtggtgggtgctctgatggtggtaagtgcgatggtggtgggtgctctgatggtggtaggcgctctgttggtagtaagtatagtgatgatagtaagcacgctgttgctggtaagcactgtgatggtggtaagcgctctgatggtgttaagtacagtgatagtaagcacgctattgctgctaagtgctctgaggtaaaatagagtggatgagaaggacaatgagtgcaggggggcaggggctattctagtgttctagatgtggtggccagccaagacctcattaataccatgacattggaggagacacctggagaaaccgaggccagctatgcagataagtggaggaagagtgttctagaaagggaagtcagaacgtgcacagaccctgaggcattacgtgctcagcaagttcgaggtactccatgaagggccatggcttccatattgtgaatgaagaggagacagaagacctatgtgaagtgtgtgggggtggggactagatcttgtctggttttatgaatcaatgtaaggatttgggcttttactcaaggtgaaatggaatcctttgaggtgtttcaaccaaaggggtgatacgatctgtcttaggtgtttaaaggatcatgtgagctgtgttgagaatacattctagggaacagagaccaggggaaagtacaaagaccggcaagaaagctactgctgtaatcaagacaagatactgacagatggtgataaacggccattgtatgcacgaatcttgaatatggagctcatgggatattctggtgggtaagctgtatgatgaaaagagtcaaggctgacttcaaggtttttggtctaaggaactaaaagataaaggtgtttactatagggaaatatagtgggcgaagcaggcttgcaagatcggagtcggagagaccagaagtctgagaagacgttcgatattccagaagagatgttacatagtcatagttacatacaggggagatgtcaggattggagatggtataaccagtgtttgaacccatgagaaaggaaaaaaggggtggaaactctttagaaaaaaatcacatttttgcattagaaatgctgaagaagtcatcgaattgagtcgttgatgccctttctttgagaagccagcattgataatttaccacttcgaacagttctcatagcgtgatggtagtgttctcttaaatatccacagccgggagctcagtacattcatggcaagcatcatatgtactcagaataactagcagtatacaatctgtaataacataacagattcaaggaaaggagcctgagtagagaatgaaggctcagtagcccctggtcccaccagctaagcttaatttagtcctagagcatgatgagttcttcgatgagttttcctattcatagtatttatttgtatgtatgactttttgccatgtcataattttccctaattaaagcatggtaacacatgtaagtaaaggtatactcatcttcctaactcaacttgaaactcaatcattcattttcttttttctttacttttcttttttttttctgagaaagagtcttgctctgtcacccaggctggagtgcaatgaagcaatctcaggtcattgcaaatctgccttctgggttcaagcaattctcctacctcagcctccccaatagctgggattacagacacccaccaccatgcctggctaagttttgtatttttagtagagacaaggtttcaccatgttgtccaggctagtctcaaactcttgacctcaagtggtctgcccgccttggcttcccaaagtgctgggattccaggcatgagccaccaggcccagcctcatttatcatttttttaacctctcctagcatttaagattgttttttaaaaataagaatatgtaattttaagttacatataccatgcacaaagctctgggctagatagtattcaaaaaaatgtgtacataggttaaacattgagaaaacatctagcaaggtattgcaaaatctgaccacttatacttacattgtaataagaccacaatttagtattagtgattttaatattatggatgatgttatggttaggctttgtgtccccactcaaatctcatcttgaattataatcccgataatcctcatgtgtcaaggcagagaccaggtggaggtaatggaatcatgggggtggtttctccgtgctgttctcatgatggtgagtaagttctcataagatctactggttttataagaggctctccccactttgcacagcacttctccttcctgccaccttgtgaagaaggtgccttgcttcccctttgctttccaccatgattgtaaatttcctgaggcctccccagccatgatgaactgtgagtcaattcagcctcttgataaattacccagtctcaggcagttatttatagcagtgtgaaaacgaactaatacagatgaattttaatatcagtgtaaaagcggacatttagatttcttctaacagtcaatttaatgcaggtagatttgtaagagtttcatgtttttttcttggttctcacatagtaatattaagttccaggttggttttatgttacagaagaatatataaagcagggaaaatatcggaagacttatggtatcagtacaaacctgccattgccgaaaagttgttttcacagactaaataaaggttgcattgtaaactgaatggtacagtattgctactgaatcactgagtaagacagagtgctagagaaagaccagaaaaaaccctgggctttaaatcttgttcttccattgatgaactctgtgaccttggacagtacataccttaaaagctggacgcaaagagaatctcaaacaccatgcacagggctgggtacattacgggttctgttaaagaaaaaaaaatagctgttgttacacttggtcatttaaatagaaaacactagctaccagaaactgctgaactgagtcacacttggtaacaacataacataagacagtaaagagaaatgtcatgttctgagaggggtgccgcgtaaagataggttttaaatacaatgcatactgcttactttatgtctcaggtgcacagacatgagccatgtaacttctgtaaatgatcaggcactttttagaccatttttataggatttggtatagccgtatgtttcaaagtaaggtcagtttgtcctgttatgctctagagaaactcgttcttgggaaagtcattaaatctgttctaaaatcaaaacaaagttccaaaacaattttctgtgctctgaaatcaaagaaaaagtaaatcgtacaacaacttttcaacaggtccaaaatctcagcagtcactccactgtgttagagccatcttgtccctgaaaatgtaggtactccagtattaaaatctcaatttgagttgcatcattagtgcagcaggcagcatgtcagtctcacaaagtcttaatttgaaaatttctctgtcatgaccaaaatattgttcaatatagcaacaactattatttcagcaaggcaatttgtagggcagatttgaaatatattactctagagaaaagaggaaaataatttggggaatagcaaagtaaaagtaaaatcatgtctctagtatatggtgagaagagtaatatacacatatgtacatttttaagatatggtagagaagtatctaacttaatctggggccatagtaaagtggtaggttctgtttttaggagacacctccttcctgcagctagaacacatccatccatctgtcctccatctccaaccatgcaggtagatctggttcattgattagctgcacaagaaataagaatctgttctgcctcctcgaaaaatcctgctgtttacagcaagcatcactgctttatgaagtggcacatgtctcttacaaacaaaacaaacagagtaatttgttttgaagtaattccaaacttacacagaacagttacaagaatagttagaaaaggtacaaagtgccttctcagattcaccaacattatacatttgccatatttacttttcaatatctctctctctttctctcactctttctctctgtctcactctctgtgtctccctccaatcaatactttaacgtttgttttctccaaagaaaatcaatgtcttacaataactgtactaaaactttcaaattcacaaaatttgtttgaatgctttaatcacatggcagcataccacatttcaaatgttgccagtggttccaacatgctgtgtttttctttatgccgtatttctctttatgctgtatttgtctctatactatatttctctttatgctatatttctctgatatacttctctctgtgctatatttctttttatgctgtatttttctctatgctgtatttctctatgtactgtatttctctttatgctgtttttctctttgtgttctatttctctttatatttctttctatgctgtatttcactttacgtgatatttctctctctgccatatttacctctctcctggccaaggatacaacccaggctcacacatgacattgggtggttctgccaccctggtctccttttatctgagttgttactcatcccttgctgaagtttcacagcatagatatttttaaagagtgcaggttttcacatgtgcctcttgaacttgagttgcaccggaggaccatccacccctacaagcttacattcctatgatttattccttcctgggattttcattgccatgacaagggctggactctccacttcacaaaagaaaacctgagctgacacgcaagaagcaccagaagtggcaggaaagagctgctgagatgtttcaaaaatgcgtatctggcccttgaatttgggaatagttatagagaggatgatgcatcattgttgaggttttaaattttttttgtatctgccctacctaagcctactcatcaaaactagaggaacaggctcgtgtgacccaaattcagccagagaggcaagcagccagcgggtgggaggaggcaggggaagcaagacagggctggaacaatgaggaaggacggatgcccctggtggttatccatgaaaacgttctttccagcctcagaggaggcaccggagccaggtcgaaagcgctgtttagaaggagggctaatgaggtgtgaaacaatgcaagtcttggccctctgagcacggctttggcaggaaccaagaaagttactcatttttagtggttccctgactgctactttgggcggtcctactgagaatcaggggaaacaagctcatgcattgtgaaatggtcctttcccttggaatgctacagatgacaccgccagatttttatttacatttcagaaggaaatgattattataataggtgcgattttcccttatttacaaacaaggttcttaattttgagttaaagtagattgtatggtaatttcttattacaaagcaatgcatgcatagaaaaaagttggaaaatacatataaaaatattcaatgttttaatatcttctatattttagtatatttagtatatttcatacttttacaactgagaaaaattacagttaacatctcagcatatcacgtttctttttctatgtacatgtgctgtaatttttattcaaatatgataaaataatgtatcactatttttgttcacctttttcattttatatattgtgaatttttcagtgttaataagcattcttcaaaaggttttctcggctgaagagttttctattttgtaactctgccacaattcacttaatctttttttttttggttgggaatttagaatatttctagtttttgttaatgctataacagaaattgcgataaatacaattatagctagtttttttctaaatttaattattttatgatactgttgataatagaatattcaagagttaaaggggaaacatttagaaaattatagtattcatatgtaatttgccctatgtatataaaaacattatttaaacaatggagtgattcttcttgtagcccagtgtcatttgaatagacagctttgttttggtatgttttctgtttttctcaccttttcttataataacctaacttttgcctccagatgccagcagcttccatgttccttgcagagccaagtaaagttctttcaaaggcaatgccgtagtctctgctgtagcagtggctccctgtgatttctacaaatgcagaaggccgactcttcccatgatcccttgcagaaggctgactcttcccatgatcccttgcagaagactgacacttcccatgatctctcctgcagcttcacctctgaccacacatcctccccttccttccccttccccatttcttccactgtcccattttcagttagtaaatgtctgctttaaggtttgctgtctttccccttcctctgagaccagaaggtacccagacacccgaagccgagcttcaaccccaatctggctaatcacagcatttttctcaattaggataggtctttgctcagaaggttttaattgcagctgctgggagaacacatttgtgttcattgtgttatggcttcctgagacaagtgtatgaacacttactgcatggttggtctagagaggtcttctttggactgtgcattggtttcttgcatggcccaggactcagtgaagtaagggagtgaaatggtgatttgatcttatgttactcatcctgatttggctttgaacatggccttagcaggcttcaggacagaagttgtgcaattcaagatggtaagaaggctgctggatcttcatgaggcagatgaggagtagaggacagaaaggaagaaatgcgagtttgaaagaacaattgactttttttttttttttttttttttttcatttaaagccttagtgatccgtaaccctggaatttccagggaaaatgtgggcaattctaccagtgttttgtctaatcactgcatggcagatgcacccaacagcaatctcttaggaaacgaaggttaccacatcggggttcctggagggaggatgttaagtggaaatgctgtataaactgcacgctttctacaagcgattgtgattctgcaattctgtctgctggcactgcacccccctgacaggccccacaaataaaccctgtaactcattcactggctctgggtctcttcttcagccacttgaacctgctgccctctttactgaaggtaataggggtctggcacagccatctcttatcccgttcattcctttcacagctctgcaatccttcagattcaatctcctacctttccatttttagctttctcaccctctttcatcatcttccccatcttctttttgctaatcagagcaaaagccttgatgtccaaggagcacatagagttgctctcttttctttctaccgtgcctattttaaggtgaggaaactgtaaatgcgaggcttccagggcttctccagggtctcactcgcacctgctgattttagagccagacatgacacaaggccatttgcctctaagacctatgctttcagcaaaattgatcacaggcagtgttgttgtttaaattctctaacagcaatggttctcaactgttagtgtcacctcaacgacctggggagtttattgaaatagatttctgagccccgcccctagagtttctgattcagtaagtctacattgggggcctaacattttgaaaatttgcattgataacaacttcccaggtgatggtgatgtttctggtgtagaagggctgccctggagcactttcttaaagataaaagttggaagctttgattccttgtgtttcaaatgtttgtttccagttgtttttgaaacaacagcgatgaattcaccgtgttctcttctgttagaattgtcctatctaccacatttcatccaactaaatacacaaatccctttaggttttgttcatctcttgcccagatagcaaatcaaatcaagtgtattaactaattcattaagctaattaacataataggtagcttaattaacttaaccctgtggtttgattcctccccttctctgtattactggtgggtgaacaatgactctaggaggtgattaagtagctggaaaaggcagaggaggcatttccttttttttttttttttttttttgagacggagtctcacgctgtcgcccaggctggggtgcagtggcgcgatctcggctcactgcaagctccacctcccgggttcacgccattctcctgcctcagccgcccgggtagttgggactacaggcgcccgccaccacgcccggccaatttttgtatttttagtagagactggatttcactgtgttagccaggatggtttcgatctcctgaccttgtgatccgcctacctcggcctcccaaagtgctaggattacaggcgtgagccacggcgtccggcccagaggaggcatttctgataaggcactcagggactctggaggtctgtcatcagcttgtaaaccccatttcttcagtgattctgctttttctctcattttttttcacctctttctttgcccgtccctcctttccatccagttctctttggctacttttggaatcttctctttgtctttgttctgctgtttcaccacaatatggtcaccattttcattatcctgattggttttccctgagcttcctggatgtggctctcacttataatatctttacacatggtttttccctgactgttaaattgtcttttgaaatcctgacaagctgcatgcctgtctctctccctctcccgtgccgtcgacactcacatgcacaggattttttcctcctctgtgctgcattttgaaaaatttcttacatctattttttttaatttattaattctgtgtcctgaatttcctaatttgtatttttttattttaactattagtggttttatcttcagaaagttacattatatatatatgtgtgtgtatgtataatctatatatatgtataatctatatatagatatacacatacacaaatatggatgtataatttcatctctgggggttctactggattcatatacatactctgcatgaaatgcgtttattgccttcttgttccatactcgtgttttctagtctttcttttactaatagatatatgttaaatatacttcttttgtatcctctttcctataagcccagttgtgaaatctctccatcgaccgtccgttaacctgcctacttccactcacgatgccaggttttctcgtttggtttgtgaattgcttttcatcctttatgcaaacttctgttccttggaactttatctttggagacacttgaagacctggataaaggcagtttttctccagagaggatttgtgtttgcttgggtcactacttgggaatatctcttgaattttagaggtctttagagccatataggtatcataaatttaggttataaactcatgggaaagtggacttaaggttataaattctttgcggtgatttcttctttctccccacagcaccaaggtgggaaagagcaagttcttttcactctttctgatctctttttcacagtgaatttactattagtcaagtccttaagagtgtatgtgacttcttgggggtttcaccatttaatacatatttttatatacatcatcttctatatattatatattatgtataaatattatatatttgtgtatcatatctttgtctatttgtgtgagtttccagtttccattttgagtggctgtaggctgtatctgctgtatcctttgccctcagtgtatccatcgaagtagaagttccaggtgatcaaggtttgcagatgtggtgagggggaaacctagcttctggggctgctaatctcttaggattgctgctctctccccatctgtgtcagggattcactcagtgcttgtgttttttgctaaccttaatcagaattagtttccacacattgcctatgtagcgaaaccttatatgaagttagctgtaccaataataggacgttatggtaggtttgagggaagagatcgacaaaggtcacaacagatggttttttgagaaccaggaggtagtgagtggttgggtaccgagtggtagcagggagaatcctggtcccaaacatttccatttagcctgcagcctgttctgagctcctggccccctctgttggggcaaaagctgtatttgaaattcctacgtgactataaatgctggtattctctcagaaatcttgtgataacctcttgagacataagaagcataaatcatgatttctgaaaggatgttctgactttcatacactccctttctgtgtgctgaaataatgaagtttgcccaagagaccgagttatactttaagtgtttacctgttctttcagctaaaaaccacttactgataaagtaggagtgatgtgggttataagaagaacccaatttttatttctgcttctaagatctgctcagtctgacgttagcgaaggtggcaaatgaagggctccacttggggattgttggttccattgctagtgactcacccgttctccacctgcacaggaggctgggaatcactgccacttactcccctggatttgctcagggacccatgagtcacagagaagcagccaagtggaaagtctggaaaaggcaatgtaccccagtcaagtgatcacccattgcatgttacatgtgcagattcagagaaccggtctgtctgagcaccttctgcaataacttcagtctaactttcttaaggctttctcagagtcctgaatcattacaacttttgaggacattattcacaaaaaaaaaaaaaaaaaaaaaaaggaaaaaaggaacacaaaatagaggatttaaaatgatggtatattttctaaagcttatttaacatacgattttgtcgccttttgctttccctcacaaataaagacaaagctggcaaaccatgattaatgccacatattggatactgacatcattaacaataaaaaaaaaagtagtgaggtaagattccatggactaaggccctgctctggtctttccatccctctgtgaggccgtctcttccccacacaggggctgtgaatgtctcacttcctgtacaatgaatgtttttcagggacaacatggtttctacacaactggtttatagacacacactctcctttttcttatcaaacattgtagcgacaatcaaaggaatatctaatttacgtagcaggacgactgaggtctcagagaccacctttgattttgtagtggttcagagaaaatatattttctcttgtccaatccagtggaaaaaaatgagtttatgcttccacatttttctgagataacctacacaattttccattaactgattagacaaaactgagcaactatttccagagttgaggaaggagtccgaggacataggaaagatggtctctggtctttacaatgtaccatagttttgagaagatataattgaatatttgacaatgccttcaataaactacaaatggatatttaattatctcataaaatcttggttgtgaacatgaaacctggagactaaatgttccaaaacaggctcattacctcagtgaatttatttgatctttatttatttatttaatcaattctcagcacattgatgcctccccacatgactgcaatatccctgcaccagcttcaagcattaagttttctcagagcgaagtcttacgcaagaaaaagtgggacaggtggaaaaaaggacctctacatgggagagccttcaatttttaaaataagttgctgcttcttatgcaattagattaatgcatgcattaattcatttctccgacaaacatttattgagcacctactatatcccaaccactattagatgctagccataaaatagtgaacaagataaatattttctcttcttatctggcttttaactagggttagcaaaacacaaagaagataacaaatattctctgaacatatcacatatttttccagctgataaaataaataatatgattagatttttgctttaggtccattgccctgaaccaaaataggatgagtagttagaagattatgaagaataacaagatgtatatattagtgaataaatgcaaaagaaaaatcattgagaaatcaaagatgttgatgtttacgtagtgccttagggtttacatacatcattccacttatgttttgatacagtgttcaaatgagggaattgggatttagaatcattaattgattttaagatttaaactaggtaatatatcttctggatggtctggttgaggcaggaagtcaggtcttctgatccatcctattatgttatctgtgtcttttactgtcatttagtgctctgtccttattttcatgctcagttagacaattcaggtcatagactgatttatcaaggatgttttttcagcataagttggtgaaatgatttctgggaattttgatgaaccctcactcattcactttcattctctctttttcctcttaaactccaaactttcctgattctcttaatgaaacaacaccccaagcaaaaatagtaataataaagtatattattcaaatagcaacctatttcatagaaatttcattgtcaatggactagtccaacagagagacctcaaggcctgtgtctttactttctgacttactctgtcctcttgaattgagcggcctttactgcaaggcttaaagtagagctgcgaaaatcttttgctagaatgaagtcctttgcatttttccaatttgtggaagttgagagtaggctgaacgtaatgctaagtggaaaatgaaagaaggatattggggacaaatattcactcacaacttcagggagttaagaatgcaacactgcctttctcttatttgaaataatttctgaattcccatactgctgagagacagaaaataaatatcaggctattcggagtcccttcttcacttttccctaccccatttttcttgtagttttatctttatattccagggtatcttcctggagacaaggtgtgaggaaggagagagggaggagtctcagagtcacctatgcatgctggtttctctcttggtatgtttggtctgtgggtcctttgagttcacagctacattctgtattctgaccacaagccttttgcccatgtgtcgactttctggtccacagaaccgttctttctaggtacatcttgcccatgtttcacctgctcctccacatgactgggcaggagaaaggtagcacattctgaccctttccagattgcactttgcaggcagggacaagcatcccctctgtaatctctgctactcctgaattaccaaatatatttaggaatcttgtcatcattatcatcacgtctccaggtttcagaatttcagaggcagtgtttttttttttggaggggtgcagttgcggtgggcaaaactaggacctttctctcagcatcaaaccaataactgatacctggctacagcctcttgggacacactgaagctaacactgggttttagacaatttggaaaaactgactgtaaatggatgacacattttctatgtaaattgcttatggtgtacatgttatttatttatctatagaattttttctaccaatgttttaaagcccagttctgaactccaagacttgctgaactgggtttgaagtaaaatattggaaggaaacatcagtgaggggcaggagatcttacgtttaagactcaacctgcttgggtttaaatctgagctccttgatttgatagctgtgtgtggttagaaaagccatgctcctataaggacatacctgagactgcgtaatttataatgaaaaataggtttaatggactcatggttccacataactgaggaggcctcacaatcatggcagaaggtgaaggagaaccaaagtcatgtcttacatggcggcaatcaagagagtgtgggcaggggaactgctctgtagaaaaccatcagatcttgtgagacttattcactaccataggaacagcacaagaaatactggcccccaagattcaattacttcccactgggtccctcccaagatgtgggaattatgggagctacaattcaagatgagatttgggtggggacacagccaaaccatatccctacttaacacctgtatgccagaggtaattcagttgtcatcctgtttcatatgattgttggggggattgaatcatagactttaatagtgccaacagtagcacccagtatatactaggtaacaaaatagtagtcaatattttactaaagtattaaaaaataggaaaaaagcaaactatttcttgtatacttcttgtcaggtagttttgtatattttattatagtcaaagaagaacaattctgaagctatggtaggtcatattaccttatcaaatgttagaaaatagattcaaatacattatttaatttatttaagttaataaggtggttagacatttgaattcaggtctttatgttgcccaaactcataagaatccacattctacagataaaggatcttagacatagattgtttatgaaactcccccaagcatacacaactagcaagtgagacaacctgtttttaggtaaggattattctgattacaaattacctagtaaaagttagaatatgtcacacagcttaaaaactgtgttaaacaattgtcctagttaattttgtgttgctataacagaatagcacaaacgggataatttataaaggaaggaaatttattttctatagttttggagtctgggaagttcaagcatgaggatcctgattctggcgagggttttctttctgcatcgttattccatggtggaaggcagatgggcaacaagcagagagaaagagagagagagacaaattcgcatttatagcaatccatcatctcaataatgatactaattcattcatgagggcagagaactcatgacctagttacctcacaatggcaacaaaatctatatatctcaacatgagtcttggaagggacatttaaactcatatagcaaaaaataaagaaaagatatgatcgtatgaaactcaaagtgtggaagtgtcaggagaacctctctgccttactccctgccatcctcgctgagccagctgctcccaagatggtcacaagagcgtggctccaggcttcacctctccacaggatcaagactagggagaagagcatctctgcgtcatgatttgttttgtagggtgggagaaaacatttcctgaaaagatgtttttcacattccgtttcatgaccagcataaagttacatgtacattcctcaggaacagatggtaggttaagtaaaaggggtttgactggcttagatagactcctaaagattttacttccagggacaggagaggtggctcacacctgtaatcctaccactgtgggaggctgaggcgggcggatcacctgaggtcaggagtctgagaccagcctagccaacatggagaaccctcatctctactaaaaatccaaaaattagccaggcgtggtggcgcatgcctgtaatcccggcctgtacaacagcctcaggcagggccttcaggagggattccagaagaaggcatcgttgtcctagaaaatgacagttccacgcctgttactgctcctgaagaccttccaatgggacaagatgcaaagatggaagaagtcatgttgattattctgaccctgtgttgtaggcctaggctaatgtgtgtgtttctgccttagttcttaacacaaaacttcaaaaagtacaaaaaaataataaaatagaaaaagcttatagagtaaggatattaagactgaaaatatttttgtacagctgttcaatgtgtttgtgtttcaagctaagtgttattacaaaagagccaaaagctaaatagaagtttataaagccaaaaagtaaactaagtcagcttacaggaagttaaagctaatttattactgaagaaaatattttgtgttacaaatgtagagtaacctaagtgtgcagtgtctcattttttttttctttctttctttcttttttttttttttttttttttgagatggaagcagctgggcgcagaggttcatacctgtaatcccagcacttcgggaggccgaggcgggcagatcacgaggtcaggagattgagaccatcctggctaacacagtgaatccccgtctctactaaaaaatacaaaaaatagccaggcatggtggctggcgcctgtagtcccagctactcaggaggttgacgcaggagaatggcgtgaacctgggatgtgtagcttgcagtgagctgagatcgcgccactgcactccagcctgggtgacagagcgagtttctgtctcaaaaaaaaaaaaaaaaaagagatggagtcttgctccattgcccaggctggagtgtagtggtgcactctcggctcactgcaagctccatctcccaggttcaaccgggttcaagtgattctcctgcctcagcctcccgagtagctgggattacaggtgtgcaccactttgcctggctaatttttgtatttttagtagagatggggttttgccatcttggccgggctggtcttgaacacctgacctcatgatccacccacctaggattctgaaagtgctgggattacaggcgtgagccactgcacctggctacagtgtttctacagcagtgcacagccatgtccttggccttcacacgcactcaccgtccacttactgagtcacccagagcaacgtcaaggcccacaagctctgtttatagtaagtatcttatataggcatcccatttttttttttatcattaaacagtgtttttaccttagtttttcaatgtttagttaggtttagatacacaaatttcttaccattgtgttagagttgcctgcattattcagtacagtcacatgtggtgtgagtttgtagcctaggagcaagcggctgtaccctatagcccagcaggctctactatctaggattgggcaagtgcacagtgcactgtgtgatgtttgcaaaacgtcaagaatcgcctaaggaagcatttctcaggacacatgatgcatggctgtattcactaatgggtaagcaatcaaactgtgtgccttaatcatggctcaatccagaaaggctgagtaggcagcacagttctaatcacacctttcatttcatttgttggatgtgcagtttgaggtgtccccagtaccactctcgagttaagtaatttgatagaaggctgcacagagctcaggaaggtcattatgtgcatggctatggcttgtgacagtgaaaagagacagtttaaaggcaaaaaagggaagaggtacatgggcagagtccgggagacagcaggttcaaacttgcggttgtccactcccagtagagttgtgccgacagcattaattctcccaggaatgacgtgtgaccccacgcacagaggattgcagaccacagaagctctcctgagcctcggtgcctatagaagtttaactggagtttgtcacagagtgtcacacaggcatgctgtccacccacattgctgaccttagtcttcagtcctaccagaggggtgctccaataccatgtggctggaccaagtggccaaaggcccccaccattaatcacgtgaacacatagactatctgctgtggcctaaggtccccaggtaaacgaagacactctcataagctaggacattccaagggtttagaggctacttcccagcatcaggtcaagaaccaaacttctaacgggcagggcacggccccctccccccaccaccccctacccagatgtgctgagtcagccctttatttcactgacagtaatcccagataaaacatttacagacattttatataagggtcatgcatattcatcttcatgtttcatactgaatccacttgaaatggaatgatatattttatgtattttatgccctatgcattttaaatagttttgaatacatacgtcaggtttcttctctgtgtctatgatgttcacagcctgatatttaacacttcatagctggttacaagctatgcatcaagtggatacttgagaagtaatatctgattataaagcaatgcctatggggttgctgaagggaaatcagtgtttacatgacatttccatttttaattgaaggatcattgaatgttttcagatttatatacactattttcatgtcttaagattgaaaaatatgtcattaacattttttaaattaggaaatattaatttatcctttcaaattaagatgaaaatttaagtagctaaaaatgaaatgaacttttgacgtgcgtgcaccactaatacaattgtccattgtattctgatgccattgcatctgtatttgacttctaaattgggaacagacttgtattatacatatgttagatattatttgcattatcctgccgggagtagcaaccattcactgtgaagtcttgcctagtttgcaaacttgtcagtctcaagaaaatatggcaggaccaaagacacctttgacacagtgcacctctgagtcttatgtatgacacgatgcacttctgagtatgcattttccacataattttatgtggtacttctcagtgtcagagtaatttatgttatatccaatgtagacattttaagttatgttttatttgagttctgtgagaaaaggtgtgttcatcatatatgatgtttaatgatttactgtctataaattcttggtaacataaagttagagaaataaatgttaaaacaatgacgtcagcaactatttaataaattagtgttgggagtcaacagggcagactctaacactaaaagtatcagttagtaggacactcactgaggaaacatatctctcaggtgcgagagcacccacttttcaaagtgttattaaagtgtaatttatacttctgaaatgatcattataattttgaagccccttgcttcattttgttgtctgccattctcagagaacttccttcttaaaacaggatcactaaccaggaacataatctctgaaggggaaccaatagacacagatgtctttgcacctgaaacaggaaagcaaatggagactgccaaaaacaaaacaagggcagcaaaacttggcaaggacattggtgtggtcatctttttaactgaagtcattcctgtgcctaaatagtactgatggatgaatcattagggtgacagttatttaattattttttaaatgtaaaggaattctttcaggagaattagcattacatttaggtagtaaatccagaatcatcatctttatgcaattttttaaaaaagaagccagacatcccacttgttctaaccaatactcatcttcaacgcccatcacaatctaaggttttatcatgacatgttaatgagatatatgtaggcacttttggtgtttttctcattaaaaaataatctcctataacatggacatatcccaggggtagtctttaattttgattcaataagtcattgaggattaagtggggatgggggggtgtcagggctgaaggtccaagaaggcgaacggggctttacctatgagatggaagaatgcctccaaccaacactgttgatttaagatgcattatcaaatggttaaagcccagccctagaaatgattgcattttctaaaattattgccaaagtagttctgcctttgctatagctctttgaattttttaaaataaatcccttttctctagcaggaatgttaaagaaaatgtttgctcaattttattctggtaataaaagcaacaataacaaaatctgaagagaaaaaaacaattactttcttatgtaaataatgctgattgaatgatgagttaacctatggttagagaatcagtaatttctaagtgtacaatgtgtaacttgaggctactatgttgaaatttgttaacatacaaagaggcagtgatctggggggttttgcttcgtcagtctactctgcataaagtcaggttatctttggaccaggggggaattcacgttttaaagataaattaagaatgtcaagtcacttgttgacctgttagtgcctaaggcagagaaatcccagtttacttcaagataaatcctttgagagcgctttatttaatcaaatgctattctcagagagtttttctcgaacagtaaaatttcttccctccgtctgacgacttcaatcttccattattccacctgagctggactggctaaaatcaccagtgatcttcagtgttgcaaaaccgatggatccttccctgtcttctaccgatttggcttcttagcgtcatttcaaactgtttgcaaacctttctattttggaacattttcctatctggaatcccctaagctattcccggcctatctgcctgctcctcagcctctgtgttgttttatctgcctattcttgacctcaaaatgttcacaacgctccaggctcagccacgggctggcttctttgctactccagtcactgactacctcacgtgttgctttcttactgtgtgacagtctctgtgcagactcagaatgagaacaataaaccagacagaaaatccgctgctaccatgggcctacatgatagttggaagggtgctgagtcgacgaaggatacagtttgtgatcgtgttacgtgctgtccacatagcaacataaagcaggtagatagagaaggggaaggagtcctgccggtttagccagggtgcacagggagggccattttgcagatgacatctgagctgatacctgtgtgctgagcaggctgtgacaggaagacctggctgaagagtattttgggtggaaggagcggcacgagcaaagaagcatgattgcgttttcaagggttcaacatggtgctgagtcccattctaggtcacatcaatgattcccatgcttttcagtctcatctcttggaagaaagtgaataccatgtttctctaagagatctcggctctctaatccagacacacatgcatataaccaacagaccaactgaggtttcctcttggttgcctgtggggatctgagatcagcaatggaactcttgaccttccaaatcgtgatgtgttcttctattgctttagccaccatggtgagtgctaccaccgttggctcagtggcttcagagaggcaactccatttccctcaattcttggaagcaaaccactcacacatttctctcacattttttctcgaacgcaatgaaatctgtctgctgcccttcaaccctcactcagcatgccagcccaacacttcacccttctgtctgaatgacttcaacatcctcctctccttcttcctctaattggctttgcctgggtctgtaggagtagcgacgatgaactgtttaacatataaattggaccttctcatctaagcatctttcatgctttctccttttcttctttcttgttctcaagtttcagtggtttgggccaattcatcttttttcggatctttgaatactccagtctcgttccttcctgagggcttggcttctgctgtttactgggcaagagggtttttaaattcactcttaccttaggtaattcctgcccatcttttccatttcagcttaaatgtcattttgcatcagagtccaactgtgaccctatccaaaatctgatgctcccccatctagctattaatttctccctcccaggagctgacggagagcctgcctgtaccaggcattcagtcaatatttcactgactggatgttgaataactaaataaaactggctacaattaactttctatttctcttttaaagtgttatttccatggggattttgatctctaatgtagaaaagtaatcatttgaaatgttttctttttacaaataaaactctggggcctgttcaaatatacgtcaacattttttgccagtttttaaatataattcaataagactgtaggcaacaaacaaacactgtgacaagaaaattttgaatctacttttttctaagtgaaaaggcacgatttcctgtacaactagttttgtttgtggagacatcaaaccctgtgtttctgacggaccgaagttatgtcttttagcctttccttatactgtgcaagtaatctgtctttttgaaatgaaaggtgtgtgtttcttttggcatatagtgttttacctttattctttctgtgccgatcatgtggtcttttctatctccgtaatctcttataaacttgtgtattataacattccttgataaaataatcctgagtataggaatcatagagattgactcatggtatattaaagttgaaagaaaacactgaaataatttagtctaaactgtttacaggagaaaaagatgaggagctgatatttgctgtaacgttgtctttattgagcaatgctaggtgtattgtgtattccatgtcattaaattttcccaataatattgtatggttgatattttaagggagaaagcccttatatataaaatttccaacaataactatatgtaactaaatacacatataaataatggaggacgctgtatctgaatgtcagctgaatgcatcagtgaaagaaaataatattaagtaagagtctctgctttccattaagcatcttattcagaaagggtcttcatggtttgacctttgcctcagtaactgacctggattttcttgtttctcagttgaagctgttcccctttacaagcaagttcccctgcgtcctgcgaacatcccgggttctttctgtctttgctcacgtcatgcctgaggtgtctcctctgcacaccccttcttcccccgacttctcactcctcttgtgtcgataactgtctgttccccaaggcttggaattccttgaagcaaaggttagaattctattttatctttttctttcccttttctctatcctccttcccttctttatcttttattcttcttttgtttctcattcctactctttttattccttctcttattttttcctgcctgtcttcgttttgaataatctttttaaaaaaacttagattatttgggttactagaaccacttaagaaagagagagatgagagttcttggctcggacacgtgtgccaaaactaggaagccactaataatttggctgtaggcgctggtcacttttccgtatggctctcatgagctgtgacgtgatctgcagggtgcctacacttctttctgtgagtctgccccttctcggggcgcctgtgaggatgcccatgccctcccctctgcgggagctgcctccctctgagacactccctcttcctccccctgcacttgccatgatgcccagtggctgccgtggcccagtggcatccaaccagctctggctttcatcactaagggcttcatattactgtgtgcatcatagctaaagttctccaagaagtaatccttaaggattttttaaaataattcaaattcatgacttacggttaatggaagccttgccctatttgggccaagtccccatgactacgggcctgtgctctggtaaacaaggaaggggcgtgaggtcaccctcggccggtgtgggcaggcaggatggttccagagaagtgtgcatgggctgcaacctctgctgggcttttgtgattgtttttctctttaaagaaagaactattctcattgtagagcattattagaacacaaattttaaaaataaaaatacaaccgcgttgttacaatggtagagattcagtaaccaaaggggggtttacacgtcaacaaaggtgaagacagtatatcctgcaacactgccggtctttttctatgtttcttttatttaaaaaaatagaattacaccacgttctgttttttaatctgctttatattacattgcccttttgaatcttttacataggaattcatattagatatataaggtaagctcaaatattagcgaagtgtgaagtacttctcattttccttttcaacttgtggtatctgaatgaatattatctccttaaagctctcctaaaggtcaaaagtgaaaacagtgaattaatgtacaaagaacaatgtgggctttgaaatcagacaccttaatatatttatcagctaaataaacaagatgtgctggctgaaattccaaccctcacttttctcatttcttcagcaaagtaataattccctcctaaagattttgtgacacttaaattatgtaatacataaaaacgtgcttaccataaaacattgcatatgtgatcacccttcctgttttattattatctcatagttccctataaacattaaagtttacactatagaatataatattagattgttaccttttccacatttacagatacctgtaagtaatgtactatgatgaggaacatactaaaagtagtctcatatattcaggtgaggttatataaataaaaataatagcacgactttaaataacctacatagtcttctcagtgcatgttaatgtctgtgatttcaggactcgaggtgatatgccgtgatttctttaaggatatatataacttaataattcatgatctgtgaaattgaagtcttaacgcacgtattatagcatcacgtgttaaattttacttctcccaagtgtcttgcagctaggtattttcaaaatgggcatgaacagctgcacagaaggtttttatcacaatcttaaactcagttctctcaattttgcgtctgcaaaatatctgaatagcatatagggtgaaattgcactgcacatattctaagagaattaaatttttgagtgactacatcaaatggagttattgataggttaattacaatgttaaactatcacagcaattctcaaccagataatttaatatttctgctctttaaaaatgcctaaactcctgaggaaatacttgaacttatttccttttatatatcgtactatggtaaacaaatactaaacactgtataactgtgtatttaaaactgtataatatactaatatttaataaagccttaatattaaatattaatttattaatacttatatttatgtatttatgtaaatacacttatttattgtatatatttactttgatatataaattatatttagtatacatagtattaaagttttaatgacactattctcttattctgaatacataggtaatatatataaaagtaataaaatatgtccataaattacataatacatacttatatcatccatatttactgtattggaatgtacttatcctgaaatcactaatgaactataatcaaaaagaaactttctgtggggactcatcattcaaatcatatctcatggttttctaaatctagggaatgacaaataaaacttgaagatttaattattatattttacataaatatttaaatacattatgtttaactataactatatatgtttctaaaatatataacgactttaagactttttcccatttctttccacatttttaagttgctggcctgaattacagattctatgcaaagtaatataaactggcctagtcaaatgctactttcactgtgaggagaccatgaataattgggcatcctgtaagatatttttgagtgagcccccaaaactatttctgagtcttaagtctagagttcttaaatgtgcagaaggagactagagcagaaatgacaggccctaagtcctccagctaagccggtgctctccccaggtgacagtcactctgcatttgcgggagccagccggaggcatagagacgtcgctctttggtgctgccaatatacattccggtgaacatctcagagcaccatgtggaatcagacagatggtgatgaggacgattctccaggctcttataaaatgttcagtgccattaattttgttaaggtcatttacactgactttatagtagaatattcctattttttattttatgtgtatagtaaataaacatcttggcttaatttgaagctttataaggaaaacattttctctttgaacatttactgctaccgtgatatatcagttggaaagataattgttaatatctgagcccttatgaaaaatctacttgtttttccctctgatagaaaaataacctagggcaggcgatgttaaaaataaataaagactgtaagaatctgcagtgttcaaaactactgagatcataggatctctgtagggagtagtaagaataatgttgaatgactgaattttaggaatgccaaatcgttttattttttatgtacaatagagttattttttttagtgtatcatttatatattttaggacatagcattagaagctgaaatgtattttttaaaaataaattactataaactaaaagagagcttgatttaagaccatggcagttgagttagagaccagagaacatgggtaaaattggggcatatgaattatgataataggtgatcaaccccttgtgttttaaaagtcagcacatgaaggtatgtagtgggagaggaaagaggggccagacaaaaaaatctggcaatgtaataagttaaacacttggaaaatgcagcccttgtctctcactcagggttggaagctcttcacgtccaattggagatccattagtatgagatctaaaacaatacgtataaaagcaatatgtgctgagcaacttacttctatgtgaactattcatttaaagcttctaatgttgctccgataataagagtttatcatccaagtgtcaacaattcttattttacctgtttatatagaacttgtaaacatttgtttactactatgagagaaaaaacagctactgctagagactgtacaaatattctgtaaaaacagcaaaaaataaaaaaaaaactgttatgcatgtagaaatgtctcgtaggatgctgtaaatcaaaattatcctcttatggctgcaagaaagaaatgattaccatggcaacattttcttattgttcaaattgtcatctaatcaagttattagtttttgaagaagggtgtggcatgacaaagtttcattcttgctgagatataaacctcctgcaaatcaaagaggagaaatttattaaaatagagctattacttttcaattcaatgagataatactgagtctacaaaatgctgaagtaaaaagctgtcattgttgacatatttcaaactgagtaaagcaggaaggtctgaagtctagagtgtccctcaaacacatatcctagagtgggctgtcactcaaacaaagctcatcaatacactggggagactgctactaaaaatttcaatgagaacatgttttgtataaccactttcctgatggttatgcagataaaaacatacgtcacctctctgaaggcttaaatggttacagtttgtctcaaaactgatccaactgaaatacatctgtacatctttgaagaaacaagtaccaacaatgaaaatagacaataataatcaatcgtaagtgccttcgtgctaaaaagtgtgagtttatctaaatggctcttatattggtttatttattccaaatataaatcaacgtttaacttaaaatgacaccttacatagagatttaacattcaagccaatctgtggctcttgttctctaaaggtggattatattctccatggaaagtctttctctttcctcttagctgaaggaaatttgctaacagatggtttggactaaagactcgtggttgaaaccatatggcttcccatgtgtatgtttggttgggaatataaatgaaaacacctcttcatttttcttttggatgctcagtgtatttttattattaattaaattttatgaaaggaaggcaacttttaagaaataaaaataagtttttattaaccaaaagtgtctctttagtttacaaagcccttcaacgcataatgtctcataaggtaattatggccagagtacagaaaggttttttttttgttttgttttgtttttttgtggagttttgttctgtcacccaggctggagtgcagtggtgcaatctcagcttactgcaaactccgcctcccgggttcaagcgattctcctgcctcagcctccagagtagctgggattacagatgcacaccagcacgcccagctaatttttttaatttttagtagagacagggtttctccatgttgttcagtctagtcttgaactcctcacctcaggtgatctgcctgccttggcctcccaaagtgctaggattacaggcatgagcccccacgcccggccctggagtcagctcattcttaactctggcctcagttttctttcttataaaatgggtttaatattaacaattcatagcctgattataaggattacatttaaaaacatatgtaaatgatactaagagtttctagcaaacacataagcttaattttgtatcattgtaattatttttagcgcttcatttgtaattaattctgattattcactcatatagatcttatctccactaattgatttgtttctaatctctgtcatagatgtcgttgcttatacttcttttcagacacttgctttattcatgatggcacctgatctacttctatagtttgctacaaagaaattcatgttgagttttaattgatacttacatggcatgtcctcaaacagcagggtaatttgatgaagaagaattttctttactgccctgcagagtcacaaggttttgtgcagatctaatgaggtattataaatcaacatgctttgaaaaagtcattgaaaatatatgtaatttatacttttaaaatcaaattcatttaaactcttttacaaactgtctaatttatatctgatcatccacttgcataattacatatctttctttaatattaatggtgtgtaatgaaccaatctattgatattttcagttttgatttttaactacagggttttgacttacatttaacatatttattactatctatgtcatgtgttctatgagatctgaaaagatataattcaacaaaattagagttaaagtgatattaagcccagtaattcctctctttgaaaatgtttctctgaggtactaaggattcctcttgaagtggtttcatctccatgattctttccaaccttggagcttttatttctagatgaatcaatgactcatggtgtggatggaatacatagttgggatttatggagctatcatttccttgcacatacagtgtgtcagcatactttttctgactgtttatcacacgaaacaactccctctgtttcagaaaatcgcctgtattttacatttaatctctaatcactttttgttatcttctaccatctgcaatccattcaggcttgtctaaatcattttgcgccttcacagaattccaactaagtaacctttttttagtaagtgactttggcattatctttaaaaagatccagagtgtttttgcccaacttgggcaggtagctccaatttctgccatttcttttaactgctattccttgtgagaaaaatagaaaaggagacatgcaagtgggcctttgtaagccttggtgtgttgtattttcaaccagtttgggtattgtggaaaagtgcattaactaccaagctagagtctattatttctgacaaacatcaatgatagtcgttcatcttgatgaagctgttttaatttgccacagcaataatgattttgcttgaggtagtatagaagacatccagcctgtgatggcagaaagaataaacgtggcagaagtaacaatctgcattacattttgaaattattaaagctaaatgcatttacaagataaatttcagagagctagtagtagaccactgcttactcattgagaactgtaccccagcacatagtgcagactgtgaaaacatgggcttgaagagaaaagtagtagagtatcagaatgttagaaatacagacctattcaaacacacacacacacacacacacacacatacacacacacacaaagagagagagagacataagacagaagtaacatcaggcttgctggttttaaccattataagcatacacttctggttggacacgataacttactgtaattccagcactttgggacgtcgaggtgggagaattgtttgagcccaggagtttgagaccagcctgggcaatatggtgaaaccctgtttctacaaaataataataataataataaaataataataataataaaacattagctgggagtggtggcatgcacctgtagttgcagctatttgggaggattgctggagcatggaagacgaaggctgcagtgagccatgattatgccactgcactgcagcctgggcaacagaacaagattctgtctcaaaaaaagaaaaaaaagtaagaaaagaaaagtaaaaaccatgcatttctgtggctttaaatatattgatgctattgtacatccatcaccactattcatctctgtaaattttcatcatactccgctgaagtactttacacaataacaccttatattccttcttctctttccctttgccccagcccctggcaaaaccatcattctactttctggctctctgactttgattactcttcgtttttaacctctttgtgtccttacgcctaaagtgagtctcttgtgggcaacatacagttgcattctgttacttattaacttactattcaacgcctcctgccaacctatgtctttggtttggggtgattcattttcgagggctgccataaaaaaagtgctacgctactcgccgagtggcttaaacaacagaaattcactttaccacaattctagagggtagaagcctgagatcaaggtttgggcagggttggtttcttctaagcgctctctccttgtcttgtggatgactctcttcttgtgtcttcacatggactttcctttatgtattcttctgctaacttacccttcttagaagggcaccagtcatgttggattagggctcaccttaaggatgacactttaagttaattacctctttaaagtctctatctccaaatacagtcaattgtgaggtactggtgtttagaacttcaaggtgtaaccctttgcggggaggagggacataattcagcctaaaacagggcgttaaatcaatttatatttaaaataattatttaaagggtagctctgacttttaccattttgttgttattcaattttcatatgtctttcagcatttttgtccctcctttgtcccattactgttatcctctatgtttagttgatatttttgtagtgtcacgttgtgattgtcttctcttttcttttttacatattctatagatactttctttatggtttccatggagataacatataacatcctacaatgatggcagtatcttaaattgacaccagtttacttcattcatatacgaaaacttcaatccttacaagtctgctcccttactttatgctattgctgttgtaaattacatctttatatataatgtaactattagcgtaaatgcataattattttatgcatttatctttaaatactgtaggaaatgaacatgggggttttaagtcaaacttagtataatacttttttatatatattttcatgtatttacctgtactagggacccttttcttttcatgaggcttcaagtgactgtgtagtgccctttcatttcaacttgaaggactttcttgtagggaacatacattggtaataaactcactctattttgattatctgggagtgtcttaatttccctttcatttttgaaggatggttttcctagatgtagaattttcagctgacattttttcagcaattaaatatattatccattgcttttcttttcttttcttttcttcttttcttcagttggagccttgctctgttgcccaggctagaatgcaggggcacagtctcagctcactgcaacatctgcctcccaggttcaagctattctcctgtctcagcctcccaagtagctgggattacaggtgcctgccaccatgcctggctgatttttatatttttagtagaaatggggtttcactatgttggccaggccagtcttgaattcctgacgtcaagtgatccacccacctcagcctcccaaagtgttggaattaaatacaaattctattgaatatattacgttgtgtgagccaccgtgcccagcctatccattgctttctaacctgtgaaatgtctatggagaaacctgttgatagtcttattatggatcccttgtttatgaggacttgcttttctctttctgcttttaagattctctctttttctttggctcctaacagtttgattattatgtgtcttgctgtggatctcttgatgtttatcctactaggtgttcattaatctccttgaatttgtacatctatgtctttcctcaaatttggaaagtttatattcctttatttaaattcatatctataattgttgttgtaaattcattgtctagcaagtctgatgcatatatttcttcagtgactgtatctagagatttatttcgaccctttgaatggccatgtttccctctttctttgtatgccttgtggtttttgttaaaaaaaaataagcatttgaaaaaaattaactaccgtgctccatgtttgcagaacacggtagaaaatgttcactaattagtgggcctctgaacgttgagatcaacctggactgaagactttaggtgttttcacgtttttggggggtacatgtcctgtctgggtttgtgtgtacattttgctgtatttttgtttttatttttttccccagctgcttttaaacatattaatattccaaagaatctaacctcatcttctcattgggaccttagatatgtgttctattgtattcctctgcctggaatcccttaccccagtgtacccatgggtttgcaatcttgctgcagttttctatacagcagtgcttgtcacagcctttcatggctgctagccagagatcccaattatgccgcccttcctcatctgacctgcaagtcaggaaagacagagctcagtctctcaggcagcccacagagcgaccatcgtgctgccagccactttctctctgcttcttcatacctagagaggaaactggtcactgggccgcttcctctcaactgcactgtgccacgcaagtcatggtatgaaacaagggagagtaagacatcatgaaatatagtcctattttgaacatctttttcttcattgggcatttgcttggttgttacagatttttttactgtcatttagcgctcctgtaaaattattttaatcttctggtagtcatttctttggtgtttccatagggaaatacaggtctggagctttctgtctcactatctactgatgctatcaccaaacttgctggattattttgatataatattgagaaaattaaacatttagaaaataaaattttggaattcaatataattgtcacatcatgcagcaaaataatgtttagatgttattaaaaaaaacttattttaaaaaagaaataaaaatacctaaaaaatatcttaacccgtttggaatagtgaagtacttactaagaatgaaaccacataatatattcaatagaatttgtatttaatgaaggattatgttacccaaatttattctcatttagtagtaaaagataaattttgactgggtgtggttgcacatgtctgtaaccccaacactttaggaggccacagtgcgagtgtcacttgagccaggagtttgagaccagtctgggaaacatagtgagactccatctctagaaaagattttttttttaattatctgggcacggtggcacaagcctgtgttaccagctattagggaggctgagacgggagtatcgcttgatcctgggaggttgaggctgcagtgatccatgattgtgccactgcactcccacctgggcaacagagtgagatcctgtctcaaaacaaacaaactaagctaaacttgatatgattactgttgtttttatggtaattttaatcaaatgcttcacgagttccacatatacccagacatattattttcttctcacggaattatttaaaatatttgtgagaaaatgtatatttatatgtatacctttcagctacaaataatagaatcagctattcattggatttacgctatagtaaatcagctataataaatacaacagaatgttcagaattgcgacattgctcctaaattggttgattttctgccttaacaataaggtagcaggtccaggttcttgacacatcttttctgttgcatacatgctgttgtctccatccttggattataggaaaatggcagcaatagttctacatttgaaacctggacacagaaattttcagagtaaaatagatatgcactttattagcatcctgtaatgtttcccagaagtactcctgtggacttcccctcacatctcattatactgaattgggtcccaagccctctgctaagcaaattcctgggagaaaaaaaaagaaatgtgttagtttgattagacaaattatacaggatgaaatgaatgttgaagtgagagctactctatccaataaacaaatgagttctttagaaattattctgtgatggtgcaagtcccaacaggagaaaagtttttccatgaaattcgagaaataaatcagtgcatttgaacaaagaaaccattatgggttttagttcaatgataagcacttcaatgtttaaaatatacataatgttatttaaagtatcttttgtatagaagttagtaaatatcatctctgttgtcatctatgggaataagtgaagactttcttctctctaagtgtatgcgtttttctcataatgctgtttttctgatcatgctgttaattgtgacctggcataaaagtaatcataaggaccaaatgagattttttattaaattttgacatcttaaaaatgagagaaataaaaccaaagattatcatcctttcactggaaaacacatgtttgattttcaccaatcagaatataaacacttatttgaatgtatttaaggtgtcttaattcctttggagatcacattttaagtcattatcattaaagaactgaaaatgcctagaataaattttttatctgggtatttcctcaataactatacagcattttgacaatgtttctgtctattacagtgagccaaggaggtgttgcattggtctctgacatgtgtccagatcctgggattccagaaaatggtagaagagcaggttccgacttcaggtaagagatacaatagtggtggaaaaaagcatgttatttttaagacatatattatttcagcttgcagttaaatttaactcttttgttcttttgaggtaaagataaaacttcttaatcattaactctaaatgtgtgtaatcacaatttgtcttcagagattttgttttttgtttataatctgttaaaagttctgtattagtcccttctcacactgctaataaaggcataccagagagtgggtaatttataaaggaaagacgtttaattgactcatagttcagcatggttgaggaggtctcaggaaacttacaatcatggcagaaggggaagcaaacacatccttcttcatatggtgacaggaaggagaagaatgagcgaagtggaggaaaatcctcttaaaaaaccatcagatctcatgagaactcactcactaacatgagaacagcatgagggtaactgaccccatgattcaattgcctctcaccggtccctcccatgacatgtggagattatggatgctacagttccagatgagatttgcgtggggacagagccaaaccatgtaaatgtcatattccaattcttttaatgtttaaagatagaaggtaaaatatttaattatctcctcatagttatttcattaaaaaactttaggaatgatgcatgttagtatcagtcagtaaagtttattcagaaaatgcatatcattttactaggattatggtgaactagatactgattttctgttgctacattatgaatacagtagtgattataatagtcctattactttagatttttgcacttatttcagtgagttcaagaaatgtaacattttccatcttacaagatggatgcaattattagaagcagctgtaaaataaaatagtaaagagaaacaagatatgtgtttttccttcttacaatgtcaccatttttgaaaaaaatccaaaaaaaggttcacagagctaaggctgctgaagtgggctacaaatggaagaaaagtactgctactattagagaggaaagaaggaatgttttttagttaaattggagtaacaacggtcgttttaaaagcaatagaaaaataagaaaactgtagtgtgtctatattgaagttggtaaaatggtatattgttttacatgaaaagcatacaaagtatagatgtgaagaaatagtgtcggaatggatataggttaactattacacatcttgactaatatattaagaagtttgtgttttcgctgaaatccatttgaggcagagcttgagatgaaatttcttattgaagtgatttattggaaaagtggtctctggaggaggggagtagaggaagtggaatagaattggagtaaagagctaagcagaaggatgtttttactggagactcacttcagtctgtttccatggcgagttctggggcacaaactgtactgacaagcaggcctcaccttttgtacccactttgctgtctgtcaataaatggcttccttcctttggctcaaggaagttctccagaggaagagttggttgtgaacagttattagcaatgcagtgagtgtggtgtgtggatgcaccagctggcagctaacagaaggatgctggtttccagtatcatattagaaaacagcagtcatttgaagtcattcaggaattttatctcttttgaaaacaaagcaacgaaataaaattgcccattcttccaagggctccccattctatgtattccttccttgtgtcaacagtcatgtctttcatgtccctcttgtcgaggaaaaatcttcttcctgcttcccttccctttccttctgtgcccctttgtcagagttgacaacagtgcatcatcacgatgtgctcacacatctgttttctcacctgtcttaagcgtctccagaatggagagtgtcttatctttgcatcctcagtgactaaaactgtgcgtggcacaaagaaactcatctatgtgtgatatatactttgtgtatcagaggaactgcccatcttgtatcctgtcatcccagaaacctagaaacttctttggtgaattttgcagagctgtattctaaaaacaaaacaaattaactcatatctgagaatatcaaattcttcaaattgcacttcatgttttaaaaaaatgacagaggaaatgcttaagctttaaaagttaacagggaagttgtgaatattcaggccaatgtcttcttagcacatgggcaatcatggaagttttaatcatatcctaggtgagtaagccaatctttactccatttcattctcagatcagacttatttctgaagaagaggtttaaattcaggatgaacattaagtctgagggctgtgttgatctggctcggggggcggtgtagggagaatctaggttgtgcagacgtatagcccgtcagggaaagaatatagataaggtttctgtagaatcttatctcagaagagaatttcaatctgtcactttcctagttttttgggaaatcactatgttgtttatatgtctctatgtttgtagcaatagaaatcaaatgccataacacctgggaagatgatttgaaagattaaattttctcttaaatacacatgtaaaatgttatttgtatcgtctatggtgtgtgtatgtgtatacgaatatatacataacagagacaagctagttatatagtagcttttttgatagatttcctagaactttctccctaggtgattttgttatctacaaataaaaggatttttaatttttgctttccaatcggattttttttatttctttttcttctttaaatgtattggtaagaaactattttacaagattgagtagaaatggtgagacatctctgcctttattcctgagcttaggtggaaagtgttctggctttcattatagttatgacattgcttgttggtttttcatagatgccctttatcagtttgaggaagtatccttctgtttgtaattttttgaggtgtgtgtgtgtgtgtgtgtgtgtgtgtgtgtgtgttttaatctgacatgaatttggaattttttcaaaagtttctacatctattgacatgaccattttttgtttgtatattttgtgaatatgagggcttaactaatttccctaagttaaaaactcatattctgaaataatattaatttgtaatgatgtttttttctttttatggattgttgaatttgacttgttaaaatgttgtttagtttttttacaggtatttttatgagttatgataggctgtagacttttcttataaagactttgttgttcctgtcagagtaaaaatggtctcaaaattaattgaaaaatgttctcttctctggaataccatagaagagtttgtgtataattgttaatatttcattgctaaatgtttggaataattcaccagggaagctacctggaattggaattttcttacaagtaggtttttaattacggattgaatttcttttctacttacaggcttatgtagatgatctacttctacttcagtgagctttgatagtgtgtatctttcaagaaattataaattttaatctaagttgtcaaatttgttggcttaaaattattcttatctttctttattatcctttaaatgagtagtaatttcacagctcaaattcttgatattcatatttttaaaaaaattttacttgttccatctgcctattaacatgtcaatattattgaacttctcaaaaaaatacaatttacttttacatacatttctgtattgtttagtttctcttcaatttcattgatttctgctctgacctcttattaatttatttcctctgtttactatgggctccatttgttcttctttttctagtctcttaaagttgaagctgagatcagtgatttaagacctttattctttctaaatgtgggtatttactgctatcaattttcctctaagtaatgctttggctgcatctcttcaattttgatatgctgtgttttcattttcctgcagcttgaattacattctattttcccttgtgattacttttttgttccatgatttatttgaaagttttctattttgttgccatatactgaacattttctaagaatctgcatggttagagattatgctttaaaggatctgaactttaaaaaatgttttgataattgctttatgggcaagaatatgctctatcttggtaaatgttccatgaccacttgaaaataacacatattttagtgttgttgggtgaagtgttccataaatgtcagttagatcaagttggttgacagtgttgttcaaggctttgtgatccctactaattttcttaacacttgtcagatctgtgattgagagagatttatctaaatcatctactaaaattgtgaatctgtctatttctcattgcagctttatcagtttttgcttcatgtattttgaagctctgtaattaggtacgcaaatgtttaaaattgctgtgtatttttgtttcttcaataccttttgttatgaaatgactttctttaccctgagtaacattttttactctgaaatcaaatttgtcttacatttgcatagccattttagctttctttgaattattgttagtctataatatatggattgttatatatgtttctatattcaatctgttgcacaacattgttttaattaaatatttttaaaaatccagttgtacatatagctgaaaaggaaattagtattttaaaaatcttttcaaataactgagtatattatttgatactataacaaaaattggcaaatgatgtcatcttaaattttagatgcaatttggatatggggttttgaaaataaacattttttattttcttacatcaaaatttattggctgaacttctgtcctaaattaattttttgtatatgcatgattttgtacctcatacattggtcatttgaaaataatgattcatcgagttatgagttctttcaaatatttatacattgtcctatacattatttacaaaaatacatttgttgatattaccatgtatttcattaggaggatctgaaagcattgaaaaactgtcaaactcatgatgatagataccagcttttgaaaattttctaattttcgttagaaaattacaaatgaaaattacaattttattactaatgaaaattagaaaactttaactttgtcatgggctcaaattttgtcattttccttgaagtaaaagactcattcagtttttataaataagtgagagatactccaatcttagcagtgatagttggtctatcgttctttaaattaagaggagttcagtagaaaagcaagcagccagctcaactcaaaactcaaacaattacatagatgtttgttcctccagagctccctcaggcttcaccaagccctagagacacattacgtattcaagtgttatgatttattaaaacaatcattttccctgctccctcaaggactttctttttttttttaatttaactttattattattatactttaagtttttagggtacatgtgcacaatgtgcaggttagttacgtatgtatacatgtgccatgctggtgtgctgcagccattaactcgtcatttagcattaggtatatctcccgatgctatccctcccccctccccccaccccacaacagttcgcagagtgtgatgttccccttcctgtgtccatgtgttctcattgttcagttcccacctatgagtgagaacatgcggtgtttggtttaagtgacactgcaccttttctctcctactgcctggtgctgttgcttgactggtgcgaaatcgccatcagtttttcccatcattgtttctgcactgtcaatggaaaaggcaactcagtgaagaaggcacataacaccttagagtattgtaaaatgattttgacctcacagaccttctaaaattccacctttccaggcatctgtggggcacaccttaaaaagagatgcattaagtatgcaattctactgagcataaaaattataattggagttaagagaaagaacatatgaagaaagaaacattatagtaagatatttgctatgttacaagaaaaattgagttgaattgaagtgaatgtcatctatactggtagcttaggattgtgtagtgatcatgggcatctgatgtacatgacctatatttatatgtgtacatgacctatattatatacttatatgacctatttatttttatagagacaatctgttacttgtcactcagcctggagtactgtaatctcgaactccagggctcaaatgatcgtcccacttcgatctcctgtgtagttgggagtataagcatgagccactgactcaattaatttgttaaaagatttttgtaaagacaaggtctcgctgtgttgcctaggctggtttctaactcctggcctcaagcagtcctccctccttgacattcaaaattgctggaattactgataccgtgcccagcccacatatcgatttattgtttatatctactatttatgttccatgggatagtaaaacccattgtattcatatggaagctgctggactacagccaagtaaggatgccttatgacacttagatgaaatgacacatggtgggcctctcatataatcagttcattacaaatgttgatgttttaaaaggagggaaggctgggtgctgtaggctaaggtgggtgaatctcgaggtcaggattttgagaccagcctggccaacaagttgaaatcctgtctctactaaaaatacaaaaattagctgggcatgttggtgtgcgcccgtagtcccagctacttgggaggctgaggcaggagaatcgtttgaacccaggagccgagatcgcaccacttcacttcagcctgggggacagagcaagactctgtctcaaaaaaaaaaaaaaaaaaaaaaaaagggaagatactttttaacagtcttttcttttgagactctctttaatgaaaggtaattcggtttttttttttttaaattcttataatcaaaactaatgactaacatgtaatccaaactaacaaccaacaaggccaagatgcgtagatgagctcatttgcagtgtagcccttgtaaatatgtaacttggggctgttttgttaaaaagagttcacttttttaggctggtaaaatattcctcatctggtttcatttatagtattattctgggttcttgagaaatcccttttccgtagacaacctaaatattaattctatcattatgtataaaatacccgaagaaaataaagcataaaatacaaagcttgcttatttgaattcaagtcagtttggggacagtttgctgacagtatttttcaccatagaccactgtctaaaagacaaagtgtattcatcacaattgaatatttatcagtaagattgatggaagtattcaaataccaatatctgagggagggagctcagattggtattgagaatttatgggtgggtactgtcatctattgttcatctgtctttctgtgctaacaggatatgtagcctatgtccaggcagatgtaattatcctcatgtttataagtagaagcgttgaaattcagaacgctaacctaacaaagtgctatatcttgtcagagtcagagctggatcctactgatatcaaagcttctattgaccttggtagtttgtaacacagataattataatagaagtttttacactcactatgcaggaccgctggaaaggggtgtgtagtgtgcggacttcacaaagtagccaatgaggagtcaaggtatggttgaaatttgcccttgagctcagcattccaagccctgcagcttagcatgcattgcatatgctgagcagaaggacaatcttggtttaattgatcactgcaaggggtgtgtcatgttgtaattggcaccacggatccacatagactagcattggccgtgatgcacactgctggacgttatgatttttttttttttttgagacagagtctcactctgttgtccaggctggagtgcagtggcatgatgtcggcttactgcagcctccacctctcaagttcaagcaattctcctgcctcagcctcctgagtagctgggattacaggcgtgtgctaccatgcccggctaatttttttgcatttttaatagagacggggtttcactatgttggccaggctcgtctcaaactcctgacctcgtgatccacccaccttggcctccctaagtgctgggattacaggcgtgagccacagcgcccagccatatttttttaatatataatttcaaattcttctatccttttaagaacatttcaaagatgctgaaactgaacttagggagctccctgaattctctgaaacttgagcttctcaactgcttccatgtcccttttctcttttcttccacaatgtggcccccttcatgtctatccataaagagctccatgtggccacagccctgattctgcatgagctgcaatatctgtcctgacactacctcctctgcaggtggcacctgcccaccttcagtgtcctgtctttcttcctttactttttttttttttttttttgagatggcttcttgctctgttgcccaggctggagggcagtggcacaatcttggctcactgcaacctctccacctcccaggttcaaacaattctccggcctcagcctcctgagtagatggcattacaggcacataccaccacggctggctaattattttgtatttttagtagagacagggttttcccatgtttgccaggctggtcttgaactcctgacctcaagtgatccgcctgccttggcctcccaaagtgctgggattacaggcatgaaccactgtgcctggctacttcctttacttcttagtcatgttcttcctcaagtatcatctcctttctgccacaccaacaccagccatgctgattcttctcatttgagtctttccacaaaggagtattgccagttaatggagatacagaggaggggctttaataggcaaaaccgactgatatggaatagttctccgtaaaattttttgttctttttgtaaatagaatatccagtcatacactgcctaacaatggactgcatatatgatggttttcccttaagattttaatggagctgaaagatttccattgcctggtgatctcctagctctgctccctcccagcacagagcagtcctcacatgtttgcggcagtcttgatgtaagacagatgtactgtgctgccagtcacagaaaaggctagcacatacttgataatgagaatcaatgactgtcttagtagttcatgcatttacaatggtatactttctactgttattttagagtatactccgtctgcttataaaaaacacaaaagttaactgtaaacagccccaggcaggtccttcaggtggtatccagaagaaggaattgtgatcattggacatgacagcttcatttatgtgtgtccttgcccctgaagacttcccagtgggacaagctgtggaggtggaaaacagtgatattaatgatcctgacgtcgtgcaggcctaggctagtgcgcttgttcatgttttagtttataacaaaaggtttagaaagtaaaaagaacaatagaaaaaagcttgtgaaataaaaatattaagaaaaaacacttttgtacagctgtactatgtgtttgtgtcttaaactgagtattattgcaaaaaactcacaagttaaaaactgtaacacggtaggccaggcacggcggctcacgcttgtaatgccagcactttgggaggctgaggtgggcagatcatgagattaagagatcgagaccatcctggccaacatggtgaaaccctgtctctacaaaaatacaaaaaaatttgccgggcgtggtggcaggtgcctgtagtcccagcttcttgggaggctgagacaggagaatcacttgaacccaggaagtggaggttgcgctgagtggagatcacgccactgtaccccagcctggggacccagtgagactctgtctcaaaaaaaaaaaaaaaattgtaacgaagtaaaattgttacagtaagttaaggttaatttattattgaagaaagaaaagcattaataaatttatagtggcccaaggatacagtgtttctaaggtctacaggagtgtacagtcatgtcctaggccctcacattcactcaccacttactgactcacacagagcaacttccaccctgccagctccattcatagggagtaccctatatgaatgagacatcttccgtctttcataccatatcttttctgctccttttctatgtttaggtatacttagatatacgaacacttaccattgtgttcaattgcctacagtactcagtacagtaacatgccgtatgggttcatagcctgggaggactaggctgtaccatgaagcccagctgtgtatcaggctacaccatctgggtgggtgtaagggccctctgtgatgttcgcacaaccaccaaattgcctaacaatgcatttctcacactgcatcctggccttaaaagacaagtgactgcaccttggcccatctctgtcctcccccacccacacggttggcttctctctgcagaacgaggggctctttacacccagcttcttgtcatttcccgatttcaacgtttcctagcatctttgagttttatacatgtatttatgttactatcatctcattacaatcatgtgattttgtaggaaaggggagacgccttattgatttgattttatatgaccggaccccacacaaggcagaagactcctctgttgaatggattaaactgaggctaacaagccagtctctagggatatatggacataacctcattaatagtctgctaaaccaattaagttaagcactgctcatcagagaatagattaacaattaaaattagagtcataacctaggctctaaagggaatttgggggttgaaagagtgctatttatgacttaaaaactgaatagttaatgtatgtccttggtatgtgcatgttactattcatgctaataacatctgttctttgtcttagcatatttttatctcgaggataccatgtttatttttcattctattttgaaatatgctttatgaattatgtgtcatcaaacggaaggagaaactgaagtacattaaggaaaaaaattacataataagaagcagaaacaaatccatagcccatgtgttgtgataaacaactgctcatttctagtttccacattcagttatcttaattttttgtagcgtattgataattttatttatagttattatagtattgctgcattggttttattatttctccattgtaggtcaactccagcgagagcagaggcacctgtctcttgttacatgaaaatgtaaagaattgcacttatggactgtgtagaaaccagggagtaaatgtggtgttcttttcagtaagaattgctttcatctgggcgcgatggcgcacgcctgtaaacccagcactgtgggaggccgaggcgggtggatcacaagatcaggagctcgagaccagcctagtcaaaacagggaaaccctgtttctactaaaaatacaaaaattagccagacatggcatgcgcctgtagtcccagctactcgggaggctgaggcaggagaatcacttgaacctgggaggctgaggttgcagtaagccgagatggcaccactgcactccagcagtgactcctcaaaagaaaaaaacaaaagaactgctttcttttaagttgtgttattgaatcatttttttaaatgatgaagaaatgagggaaaccaaaggcacattataaattttattatgaaaagtgtcaaacaagcccaagcccaaaagcaggtgaacacagagcgtggaggtagctagagccccctagataactctcactgttgtcttcatcaagagagaaatgctatcacgttgatgcccttggataccacaagcaataaaactgcacactcaggttatgcccatgtgtccaagggcactgatgttataatgtttctctcctgatgcagagaataatggagagatatctagggacctctagctcttcccctcctgtatttccacctgctttttggctcctttgattccttttcttgcttactattttatttgtcatcatttatatactttatagatttcatatacttataaagttagagcagatgcatacactgatatctcggttggtatcctatgtggtattggctctcctctttagcacgtcttcatttctatgatccttctcgtgttttccatgatatgttgacatcttctgtcctctcagcaatgctaagagatgtgttatatactgaccagagaaaatccagatcttaagattcggagcatcaccccatgaggtacctgttccgtgctacttcctggccacacaatctgaaatggacctttggtccccccccgcagcctccctccctctggcctttgactttctagcactgaccagccagaaattctatgcacgtctatgcttccaatttgatttcactaagcataattcatgtttatatattttctatctgcccacaagattctgagccccgtagagagaagaactttgttttattcactatcatgtttccagtgttcagtacagagcctgcttcgaaggaagcattcagccattattcactaagttatttaattttacttttatatcaggaatgcatttacatttacaggttgtaaggcaacaataaatattgattcagtatgcaaaattttcatttacaggtaaacttgtaagaacataattattcccaataaaaaagctgctgtttctttgcatcatatactgtattaagcattaagccttggccatttgctagatcatttatgtacaactagaagaaaaagtagaaagtatggacatcattggattatgattgttattccttcttcccatcaactaaaaaatttagtttactaatagatgaaacatttgtaaagttagaatcaagcccatatatcagggggttttttaagaaaatttggaaactataatgaatacaagagggaattttaaaaacattcaagtttggtttcttgttggaaaaaaatcccctttgtgacataatccgtttccattccatgtccctaagtggaagacaaagaactgtcttttattttttgaaactcaaacatgatcttatttcttgaaccagtgttcatttctgtaagtgatttttactctcttgtctagtggagaaaacagtaaggtgaaggaggacaaagtgggattgggcgctcagtccaggtttgtcatataaagaaaggaggctttagctcgcaagcctttcctgacgtgctgtatttgagcctgccgcgcctaagtcccctgccattgtccaaagtgttttcacaacttaaaaaaaattttaaggaacataacatattcctatgcctgtaactgaaggcaggcaggtagcttttgaaggaggattcatggttactaggaaactgaagcagagtaggaaaaatatttgccgatgattactgctctttcaaagagcatcaactgcattttttaagaactacttaagaaataccacaaacaataatatcccattgacactccttgaagcctttatgtccctttgaaaaatgacacactctgaatgtttcagatcatatttgtgtggctaaacttgcttctgataagcaattcaccaaatagggctggtggaatatcctccctctctcttacacagtcttttcaatatctgtagtagaaaagtaattttttcatcaaaataaaatacacatttaaatagtcttctgagaaaataggtgattgttacttgagcctatattaatttgttagcttcaaaatacaaaacatagttgatgaattatcaacaaaagcccagtttgtcatgatcatcagatatgccatctcggggactatttgaatataaatgctcttcaaaatgaccttctgtaacactttttctgtgtgtgtgtgtgtgtgtgtgtgtgtgtgtgtaattcttcctgtaaaagaatgggttgaaataggagatgtgattatttcttccatacattagaattataacaccctgtgactcttagccatgtgtttgccatattctactttagaataagattctgcaaaaatttcatggctctgttcaggagtgtcaacaacctttgaggctaaaagaagcctgtgagatcatcatcagtgatatgcaaaagagtttaggatcaatattaaagcagtgaacgttcaatgaccaaccagtgcattgattttggggccattccccctgctccctaatttttctaattcctttaaaatctcttcagaatctcaggtgattcattttgctttcctctatgcctccaccggaaatttgttgaaggaaagaagagagttagtgttcattgatctgccctagagagaaagtgatctggttttcctggggactctaaactgtgcaattaaacacactccagttaccccgaaggttctggtttaattggtcaggaagatggaccagtcatgaagatttttaaagagaatgtttaattgtgataaaatccacataatatagaatttagcatcctgaccattttaagtgtgcagttcaatggtgttaacacattcatatggttgtataaccatgaccaccatccatctccagaattctttttatcctgcaaaactgaaactccatacccataaagccataacttcccatcctcccctacccacatctcccgacagccaccattgtacttcctgttcctgggaacgtgatcactatagacagaatgtgctataaccctctctctctctagggcagatctgtgaacactaactctctcctttgcttcaacacatttctggtgaagacgtagggggaaacagaatgaatcatttgagattctgaagagtttttaaacgaattggaaacattagggagcagggagaatggtccccaaatcaatgcactggttgttattcaatgttcactgctttaatattgttcctatagttgataactcttctgcatattaccaatgatttcacaggcttccattagccttaaagtttgttgacgctgctgaacagagccatgaaaattttgcagcatcttattctacagtagattgtggtgactagtgtaggtaactcaatgttagaccttttataagtgcctgctgtgattctgatgtgcaagcgaggttggtaaccattggcctgcctggtgtatgtcatccgtgatatgagattagagataggtgactaaatacagatgggcttgcttttctaaacctgtttgatagcataaacatcgtctgataatgtatatggaaacctcatcgttggaaaacactttcagtatctgctgccttctacagctcctatatgtctgcagaagctggaagaataaggacagctgatttgtttccccgcagcaaaaatcctaccaaatcttggcctccatcaaataatgttcttggaaaaataataaagatgtgaggccaatgagcagctcccatgaacaggaatcccacggacacaatgatgcagcactggtagatctcagaagccagaggcaaacctacatctagcagtgatatacaggagtcatggaggtttctagcatgtatgacctggtatcaagcttgctgccacgatatcatgcgggatgaatgaaaaatgtccaatcatagctgattcttgcacatagagattagtacagagacccccttggaatagttctttacatttcttgacattgcaatcaattccttcctctctatccacattttcaatcacatagcaaaaccatttttttattgtattgaaatcatttatttaattaataaaatactgtgtttgcaatattgcaaaacatgcatatgaatgttgcaaaacatgcatatgaatgttacaaaacattcatggaagaacaatgactgctatttatgactgaatcctgtgatagagtggggatagaggtgggtgcctggatccctcagtaaaattaccgcccctgcagactttcgctttagaccagagcaatggttttctgtctcttatcatctggggtcaccagtcgttttccactgccaccagcaataatacttgcttgccatcgtagagaatatactggcaagctgggtgagtaaatgggagcaccctatccccaggatgacatttcatagtctctgagtggtagtctttgacacttggcgtcccttttccaatcaaccctgaatgattctgatacacttgacccttgctgagaactgctggtttagagacctcttaagtttctgtattcatattctaggggaaatagagtagctagttagatggtttatcaatttaactaggatctaaaggtaataaatccacccactccacccttcaacagcattaaatgccctttggcaccaaattctaaattttatgaggaattttacctaagcttcctatttatactaatggggaggagaaggagaaaaggagaaagacagacagatacctggaaagattcgggaagcaatggtttgtcagttttcagcttgctgatgccacctgcagttatgtgtgtgtgtgtcttaaattaattcctcgctctctttacctgctagacttttcttaagtgttcagcaagcattcagaaccagctctacccttagtgatgagctgaggaggtgcctcttgtggtggtcattttccctgccctcacaatgatgctgccaggagcttgccatcaatgaattgtagagaccgacactttgctttaagacgtcctgctgtgccgaaatgttgcttcctctggaaggggaaggtagtcaaccatctcactccattacactttcttgtgtatgaaagaatttgtcagatctgttgctcccagcagattttgatgaaagacaggaggaaagaagtgggagttgcccatgccaagcgggaaggaccacctggtgaaagaagagaggagtgcaaggtataggttggcgccaatctgggcatgcagcagatactcaaaggaaaatggagatgttgttaaaggcataaagctgcagttacataggatgaataaacctagggatctgatgtatagcatgaagtggttaattaacaatgctgtattgtgattaataatgcagtgttgtggttagcaatgctgtgtgggggttaacaatgctgcgttggggttactaatgctgtgttggggttactaactctgcgttggggttactaatgctgcgttgtggttaataatgctgctttggggttagtaatgtcgtgttgtatttaatagtgctatattgtggtgaataatgctgcgttggggttaatgatgctgagttggggttaataatgccgtgttgcatcctgagaatttgctaagagggtagatctcaggtgttctcagcacccacacatacacacgtagccacatgaggaggtggatacattcatttgcttgactgcagtaatcatttcactttgtttatcatttaggacctttaaatatatacagtatccctcatctcacacacacacacacacagacacacacacagacacacacacacacacacacacacagcagtaagcaattgcaatccaatgtcagcttttcttttcttttttgagacggagtcttgctctgacacccaggctggagtgcattgttgcaagctctgctcactgcaacccctacctcccacattcacggaattctcctctctcagcctcctgagtagctgggattacaggtgcactccaccatgcccagttaatttttgtatttttcatagagatggggtttcattatgttggtcagactggtctcaaactcctgaccttgtgatccacctgtgtcggcctcccaaagtgctgggatttcaggcgtgagtcactgcacctggcccaatttcagcttttctgtgctttgtatctgctgttctcaaaagaaggggcggggggaaattacaaatcactacctggagccatctctagggaggtttttagcatccaaggcaacccttcagctactgattcattctttcatttccttagcaaaatgagcaagccctcaggaactgtactgagctcttgggatgaggacaaataaaagaaggaacaacagaaaagtcctcctctgttgtagacagagcgtagaggaaggctcaggggagacgtcacagccagggcttggaggatgggaaggaaaggatgtccccacttgagcctatggggcggtcggtcccagaaggaagaagagcctgtgtaaaaaccctgagggaaaatctttccctgcctttctctcctagagactgacgtgagcattaagggctggatctaaatgacaagaagttaaagcaaacataccagccatcaaatgcataactacatagaggaaagtaggtgcgaggaagccgagcaggtctgtttttctggggatgtttacagctggagttcatgcatctacacagcacagtataattttagcattaacttccctagacaccctcttttctgatatccacaggatcccttttctcagattggcttggtcctacttagttttgttaaatgcgttaggaaatatatgattttatttctaggaatgacccaagattaatataaggtagagaaaaataaactgtattaagaagaaagtgttttattgggctgaagtagggcaaatgataaagagaggagatatacaaagaaaaactttttaatataccttaagttctggggtacatgtgcacaacgtgcaggtttgttacatatgtatatatgtgccatgttggtttgctgcacccatcaactcatcatttacattaggtatttctgctaatgctatccctcccctagtccccaaccccccgacaggccccggtgtgtgatgttcccctccctgtgtccgtgtattctcattgttcaactcccacttatgagtgagaacatgcaatgtttggttttctcttcttgtgttactttgctgagaatgatggtttccagtttcatccatgtccctgcaaaggacatgaactcatcattttttatggctgcatagtattccatggtgtatatgtgctgggcaaagacattttaagaactgtgttcagagttgtaagaagtatgatatggaaatgacaattcttggcctcagtaccttgcattgtggtgagaaaaacatgtggctcatgttttatctcagctgcattttatttacaactatttaatagcctggtgacctgaaaataacttctctaggtcttggggcttgcattgaaagtagttccctactttatttgggattccatagaaatcagctttaggggcagtttaattccagtgaagcgagagtgagggaaattggaaccagacagagatgccaaacgtgctgggaagctgtgctcagcttcagaatcagcccagggagatgctctgtctcaccggtgcctctagacagcctgggtgtacccctggggcccgatgtttaccatgagtcctctcagttcctgtgtccccttctcaaagtatgacccctggggcattgattccctctgattttgggcatcccatatgtctgctgaagaagccagagcctcagcaggctcagtgcagccagcgtttgggtgaggtggctctgttttatcggccaatatcttgcagggctcctggctctgggtggcatcagcacctgggttctggattcatggccacagaaacagagtgagccattgcaccaaacaaggcaggcagaagtgtgctgctaagaggggcacttggaaactgaggcatgtttgctgagcgcttgcattgtgccaacttctgtagggtgcaagtatattcacatcttttagtgtcttgtaaacatgcttttggatctcatgtgattactggtatgcatgtatgcatgtgtgtgtgagtgtgtgtgtttgtgtgtgccctgaattatagcagtgttttcttctcttgcccaccctcctggctcttgttttgtgtggtgctccttaagcctggatactgtggttgctggtcaattacaaacaaccagatgtgaaggataaataaaaaaaattgcaaagttttgccaagtgtagatataagcccgggaggaaatatttgccgaacagtctctgtgtatttaggattgtttactgatcaaccacggatttaagtgataagttcccaagttacaaaaaaagaaagcccatttgaatccagcatcccatgatgctgagcagagggccctctgagtctctcgttctcatctgtgatttgggaatcagcctcctccattgttgacttatcgtggaggccccaaaggtctgccctgacctgagtggttagtaatatatgtcacttccctgcatgctgtacctggttagctccagctgctgcctgggcatgttcatgaagtaaaacaaactcatgtctgctgctattgtgtgaggctgatgcatgatggaggtgtgagctggacggtggtgcaggctgccggggcggtggtgcaggctgctggagctctgcttccttctcccatgtctctgcctccgacactcctcactgtttcctccctcgagctacagagcaaagagcatgatccgcaaaacgccttttggtctagagttcgaagagtctcctctggcttcctaagcccacgtggaaaataggcactgacgttgctctcctcaaagccctgataaattgtcaggaaggaggcaaaggggctttcaccttggatctcagggagacacaaaagagaagaagatgggagaggggcttgcgggcaaagctccttcccaagccatgattccccacagtcctggctgcatccaaaccctcttccacgttcacacagtgtgcaaacagcttttgcctttgtatagataggtgggtgaacgtgaggatttaatttttctacttcgcatgacaaagtcctgttgtttagcaaatggcaggtttacatgaacttataacataacttggaacatttaaatcaaattccctcacacaaaaattcacacctcattgtcaatgcggtgcttctgagagctagtcacagctggaaattgccaatcactccaagcttactgttgcttataccctggaaccatcctatattttgattgtcattaagggatctttgttgggctattgctaacacacagtatctaaaaatcacataaaatattagtttcctttctttcctcaggctagagagttccatctactctctgatgcatttttagtggtgttaaactgccttaaggcttgaagaaatgagtctaaaaattgccgctatgaaaagaaaaaatgacccagaaaagacacattatgtgtgaaagtcaaacgggtaataaaaggcatttcaatatccacagcagatgcacattcatctctccgatgatggcattttctggaatgctgagcaagtcacacaatgggacattgtttccctagcatgtggctggcttgcttgcaaatggtcttcccagccttcctggtcttgcttattaggatcgtgtccctaaggggcatccctcagcagaggccatccggtgaattgtccaagttcccatctgagtagtgtaaaaactcccttataggacaatcggagaggatacctaaagcatttattttaaaatagagatgaatgttcccaagggttcacgtgccgcgtggatgctgagagactgcacacagaggccgggttgtgtttttcttcctaaagcccttcagttcagaggcttcttccacatctaggagatgttctgaattcctgcttctgcctcctggtttttgctcacattagttccaaaggtatttattgcagggctctcagaagctccatgagcagtgctggaagctgtgagagatttcaaggtgaatgacacaccgcggttccctcggaggttaacaccttcccaaccggcctcttctcccaagcctcccactcttccatacttctgtgctttgtgttaatatcctgagactaaacctgagatggagcaataaaggaactaagttatatgcctcagaagtgagagaagggaggtgaggtggaggcagagggtataaacctaagtcattgtatctactggggaaggacaccgtgcaacttcaaaacaggaaggtaggagatagcctccatggtaatggaaataacctttgaaaaacattcctggacaaaccaagttatatgcaattgtctgaacaaacctcagctttgttaccaacagggttttgctgtggtggttttttaatccataacacatatactcattttggaaaaaaaaaatacattctatgcatctttcaagacgtaacccaaatttcagtttccagcataagttcttcttatctttttactaaaggcaaatcagttcttttttgttaatattcccatagcaatttagatttaatatattgaccaagagctgtttgatgaagtatctcttacactagcagctcattaatacggtccagggctcgcctcatgtctggtgcatttggggacggccgtaaatgagtgccaaacccctgtaggtcgggcatagcagaggcccatggaaaagagtgaagagtgaggagcagctaaatgttttcaagatgctgaagaatattagatattggaggtgttctggttggtttttcctctctcattccttttcttgaatcaaacgtcactctgttgctctaaagttagaaaaacactgtcgtctttctaatagcgtttccagaaaactttttagcaccttgttcaggaaactccccatataactgattctacgtattgggaaaaagcagtgttttaatgtgaaaatcaagtaagatggaggaaggcagggaaagagaaaaatagagaaagagagagggagatagggagaaagagatggcaaagatgggagaatgacccatatataataaggatagcagtgttatttgcaaagtaagttaaaatggatatatgaagttgaattaataagtctataaattctgatgtataaaatgtagttttatttgtactgtgattggtaatttcttttgtgggatcctcattttgtctgagtcagaaaactttatctgttcattcttaaaagagttaaaattagtgatttcccagtgaagcaggttaaaagtcagatctggacatcccttcactctctctcaaggacgttaagggcccgggctgtggagagggcattttggccttagtgagagcaggcatctctcctccatcccgcctgtgccactcactcccagtcataacctttcctaggcctctgccctggaggcaggtggacctgggggaggctcatgggcttgaccttctccatcacgggctcctcccaccttctccagactctatgaagcaccaggagacacaggggcttctccatgaggccacagctgggaactaaggagtcctgcattactcctgaacacacagacacaacgcgggggttctgtcttgttctgtctcctcacccagcttgggtcttggtcccaagtatggtggggaaacatgacactgggcttccacagcctccacgccaccatcacacttatcaccacagctccagtgacaagttctggcggtagccagaccgctttaagcaggactcagctccattccttctcactgggcaggaccccccagccagggcttccagcctctcctgcctatatccaagcacaggccaggagttctgacttctccttgggatggggtgcctgcggggagggccaggccaccacctttgctgtttgggcaactcatcgattccacactgtgggctttgactttatttcttatagtggagaagcaggaagtgggagaacctaccatcacatctcctttacacctatttcatgatgtacacctggatcccactgtgaatttggaagtctgtaacttttaacgtgtgctgtgctaggacaaaagtcctcagagttttagtaaaatacagggggaagaaaaatcaaagctgtgcatactcacacacacacacacacggatgtgcacacacacacggatgtgcacacacacgtaaacacacacatagacccttcagcattcacccttcctcctgctcacagctttgttcctcttaagcaaatactttcattcaagcaacatttctaaacctttgataaagtgtggctgcagctactgcccccatgccatccatctccattttacaaggacaaatatggcaaatccaggcttgaatgtcacgctgaagaaaaggtttcctcaaatttttgtgttttctgctgcttgagactgaaaaacattttacctaatgtattttttctttttgctgaagatgcaaaaatgtttaaatgcctaccttcgatacctaataatatatatatattccttttatatttatgagtactgaagtatatgtttgaagtggactttttaacacagaaagatatatatctgtctttctatagctatctatccatctatgtatctatctatccacttgtttatctttctgtccatctatctgtcatctgtcaatctatctacctaaccagatggatatctacttacctatccattcatctatctatccatctatgtatctatccatctatttatctgtctctctaatccgtcaattcctccatctatctatcatctatccatctattcgtctgtcatctatttatgtatctatctacctatcatctatccatccgtcttttatctatcaatctatctttccatccattcatctatccatgcatctgtgtatctatccatctatgtatctgtctaatccatatattcctccatccagctatctgtcatctatccatctattcatctatcatctatttatctatctaatctatgtacctatcatctatccatccactgtctatccatctttccatctttccatctatccatccatccatctctttgtctatcatctgtctctccgtttatctgtgtatctgtcatctaatctctctatcatctatctatctatcaatcatctatctctcatctatctattggttgcatcagcagattcagtagacgctgagcagtgtgggttgaaaagagaggtaggagatccttacctagccagtcagtagattagtgtaatctctggtaaacagcggacagctaagtcaacccatttcctgttttgaacattagtttaatcttcgagtcacctcaaattatttttcaaaaatagttatgataccaatgtttaataagttctcaaatagttatgctctatgagaaccatatttagaaattgcttgtattacaactaaagcgtgtttggaaatagtttactcacttagaaagagtctttatactgaggtaaagtgaattatatggtgataaatgtcttccgaaatcaaatacggagcaatttcagaagtgttaagcattgaagaagcagaaaatgtatgtttccctgttgtatttaattgaaaagtcaaaattttgctgctttgtttgagttaacttttgctgtgtgatatttattgtcaatgtaccatgtatcttgatcttacacaaaatcggttctccagtatttcttacagttactaactactaacaattgtctcagttgtgcaacgtaattaatctagggcggactaaagtaacttgccaatagaaaggcactgctagcttttttctcctggaattttcctctgagacttctttccagaaaaccaagttagattatctgatgttatatctgatttatattacttcaaatatagtaatcataaatcagtgaaaacttagtttattatatattcgacatcgaaagcacacatggcttggaaattgaactgattcatgtgttagataaaatgagagcaaaagattgaattaataaattagaattggggtcttatttagtttctgcctcaacttgatttattcccacgtggagtctcctcctcggctgtgctgctggaatggcgtttacccacattggctctgtttgccagctgcaatcaaatgaagaggttgctcctgttaatatttttaatgctttgaaattagagaagcttccatattctattgatggctttttccgataatttgcaaaaaggtttcatgatcgtaattatggaatgtgttctatactgtactctcaatgtactgaatatgaatgtgcgcagagatttctggactagcttgtgataccaggtgatgattgtggaagctcaggagcaatcctccgctctccactgaactagtctttgaaaactttcctttggtggaaatctgagaagagtaagagccgagttcaggtcctggagagtgcacatgactaccttgatgggtgagaagaaaggaacggtctaatagaaacagcctaagtgtttttattttaacttttaaattataaagtaatagaatcaggaaaaaatataatcatttgaatatataaacaaaaatttgtattgtgatacttgtgatactaccgctcaaaaatgggttgtgcctatcttcctaatatttagatataaatatagatagatcatagttattttcagtacatacaattttgtattgtccttttttctttttctatattactacatgtcatttttatttttctttattgctacatatattttatatttgccttttataaagcgatgttgcattctttcaaatatatccaaaaaaatttagtcaagcacagtcctgttgttggacactctaatgtcttctgaagaatatcaccagaaatttcctatattttggatgataaacatatattgccagaaatgaaatcaattagtcagagtggtgatattttcttttctaaaattgagaaaaactgtagatatttatggtgtacatgagagtctggaatatgaatacattgtgaaatggtcaaatcaagctaattaacatacccattacttcacatatttgtcatttttcatggtgacaactttcaaaatctctccagacaattttcaagtatacaatatgctgttattaactacagtcaccatgctgtgtagtagatctcctgagcttatttctcctaagtgaaattttgtattatttgtttcctctccttcctccagcccctgatacccacactctgctactgggagttctattttttccagatttcacctagaaatgagatcatgcagtacttgtctttctgtgcctggttcattttacttagcataatttcccccaggatcaactgtgttgtcacaaatggcaagatttcctcttttttaaaaaaggctgaatagtattccattgtgtacacacacgcgtgaacacacacacacacacacacacacaccacattttctttatccatttctcagtccagtgttggacccctgcattgattccacgacttggctattgtgagtaacgctgcagtgactatgagagtgcagatatctcttcaacgtattgatttcatttccttcagatataggatcagaagtgaaattctagatcatgtagtagttctatttttaattttttcagcaacccctatactattttccataatgagtatgctaatttacatattttacatttctaacaacaatgtacaagggttcccttttctccacatcctcaccaacacttattattttttgtctttttgataatagccatcttaacaggtgtgagttgatatctcactgtggttttaatttgcatttccctgatgattagtgacacggagcacctttccatatacctgttggtcgtttttatgtcttctttaaagaaatgtctattcaggtcctttgcccatatgttacatgggtgatttgttttcttgtgattcccttgtttgagttctttgtatttgtggatatgaacgcattagcaggtattttgttctccagcatcttctcccattctgcagggtgtctcttcactctgtttgttgtttcctttactgtgcgtaagggttttagtttgatgtcatctcgtttgtctgtttttgcctgtgttgtctgcgctttgggggtttaggcttattgattgtttttctcaaaacagaatacaatttgctactgatacgtaaaggaatattggttggatgtaggaaaaaaatgcatgaaaaagatagaggtgttataggagcagagagccctccatgactaaggattggtgtgctgcagtcgttgaaatatagtgcttgctaagttgaagcaatgcttcccccatccctccctttctgtttgaactcccctggaatattacactgaatatcagtgcctcaggttaaggggatcattgaagaagtggccacactgaaattccaactcttcctacccgaggactctcatgtcattttatttattttcttcatggtgctttatgactttttgttttctttatgtttggtttggttatttttttctttcttaactattatgttatctatatgagattgtggctttgtgctattcacttctgccgctttggtacttagagtgtgacacatagcagatgttcaatgacaatatattgaaagaatgatgaaaactatgaatattaaaatgtaggtaaacagaaagaactggagactgatacctggaatagaaaacacaaagatataacaattttttaaaagaaaatttcttaaatgaggtttaaacacagaccaatgatcaaaaacgatggcggcagaatatgtctacaattacagatatcttaaataactgtgatggctagcaatgaaaatgggaatcacgactgggttttgtttttttgtatttttcacatttcaaattagtacatattatgttcttatgatgccgggtttctcaaaattagttccatagaactctagttgtcctagattcctggtgaaaaaaagaacttcctagacagataaatctggaaaagtctacatcttttgaattctcttcattattttctaaaataagcttttgcatattaagttttattaagatgagatgcccctttagaaaagaaatgtgtttaattttgtttacctagaattttcccagttgctttgactctgatttgatggctgttgccgacatccatggcaatccctagagagtgttacatagatgccgtgggggatgctggtgcgatgttacttgaatgatattcactctgatattatagatatggattttttttccactaagcaagaaaggaaagcatctatttatgtttcccctatcttgtctctatgattaacttcatccatccacactgacaactgtgcttcttttccttcacatctccttatttcaattctgtttcctcaacatcaacccgtggtttctcaaactaaaaacatgagtagaatttcctcttgtaacaatgcgcttgtcagagagttaaataagcctacatttaattcaatgccagaagccaggctcagaagaagtaactgggtggtgttcaaacctgatctctgcctctcacacttttgaatgcagctgtccagtttgtgttctgtgacagtgtcttgttaatgtttacaaccgtaaagctccatgtttgcaaatgcagctctggagccagggcagttttttctctaaatccaggctggatggattgctttcttctaaaacacaggtgggtgcagtggctcacgcctgtaatcctagcattttgagaggctgaggcaggtgaatcacttgaggtcaggagttgaagaccagcctggcgaacatggtgaaactctgtctctactaaaaatacaaaaattagccgggcctagttgtgcacatctgtagtcccagctactcaggaggctgaggcaggagaatagcttgaaccccggaggcggaggttgcagtgagccaaggtcgtgccactgcactccagcctgggtgacagtgtgagactctgtctcaaaacaaaacaaacaaacaaacaaaagaaaagtaaaatattctgttcctataagaatttctgaaatatcactagctttcttttaaatataattaacatgtgtgatagcaaaatacagtctttactgacatattttcttaacctagacttttttacttcttgtttttgtaaaatatttattcacgatgaatgacatccaacttcctcttgttttcagggtacaaaatttcttcacatttattttcttattaaagccacactattcagtgaagtcatttttgctattttattctgtcttagtcatgacaagttaaggttcatgtgtttgtttagttctgaagctggcacaacaggaatctgaacccaagtcttttgattttataacctttgctaaattacagggttgcctctatacatactacctaatgagttgcttaatgtcttaggctgttttaactgaacaagatcgtagcagccattttgctgatttttttttttttcctaaagaagtcttctgtaaataatttgggtttttttttttcttttttaacggcttagggttggtgcaaatgtacagttttcatgtgaggacaattacgtgctccagggatctaaaagcatcacctgtcagagagttacagagacgctcgctgcttggagtgaccacaggcccatctgccgaggtaaggcacctgcggtgggtaaagcctggattatctctttctttaaggttggcatttttatgaatatacaatttaagcatgaagcattgtgtatgggaagagtagaattcggtagtaatgtatgttttcatagtgatgtgggtaataacagaaacctttccttggaatttgctgagaggctaacatttccaagaatatttttgtgttttacatttgaggatagatgtgagcaaatccacacatactgagtataacttggtatctatcaatacacacaaacagtgtgcatgtgtgtgaatatatgtcccacagctggacctgccggaaaggtttctgtgcaccccgcaaacctaaaaatgttcactttcctattgcagtgaggttgaattttttaggtattaattatgtaagtaataaaaggaattgttagcctgattgcaaatcatcattttattaataaatgatctttaatctctaacatagttagcagagtaaaatattcatcattattgtcatcatcattttctaataaaacatacgaagtcagcaaaggttaaattacttattttttactgctatgaagtatacacaaattcttaccagaattacagaaatcatattgaaaagcagaaaattattttggttgttttaaaatgaaaataataataaaattaaagaaatgctgggtttggaggttttgtttttgaattttggccataaaatgatttatgtaaactggtagttttgggagaaaaagccctagtttgactaaaaaggaaagcttcatatgtaagaataccttatctttccatatagtcttttcacgtgaatggacttatacattttaaacttttaagcattttagttattaaaaaaggtacaacaagcatagtgtcattgcagcctgtgaaaataactagttaccaaacacgtcactatcgtcctctaagctaagaatactctttggccccatttactgtattgtacctggtccctataaccactaggggtcagtcacatgcaggggatacagctttgcaggacccgccccaccggaaggggagggagggtgtatggcccagctgatagcgagttgtcacctcttaaatggagacccttcaggagagtcagcaatctctggtccaggaaatgcacatggctgtccccttctttttgtcactagacaactttgattgtgcatttttcaattctaacataagacccttaagcacttcaaagagctgtactaaaattcatgttcccactagggctggtgatgcacaagcctcccaattatacaggaggaacgagtcacatggattatttttcctttggggaaaaaaaaatccttcaatagttttcttgctcttatatccgggaaataggcttcattatttttaaagttcactttagacaaatagtaaatgtgcattcttttaaatgttacttttaaatcagtattttagagtaacttaaatatttgcctttatattatttgattttatatgtttacctatgacattgcctttcttggccctgactctcatcttaaactcaaagccctttctcagtatcctatcccaaagatatcacacactcagaggtgcttatcacttaggaaacagctgctccatccaggctgaaggtggagacatttctcccatccttctcaaccccccagctactcacgcttagagataattagaagaggattctttgtggtttcctgttctcgtcaattcaagtgtcccacttgatcatattttggaagagaacacttttttcgcagggtctctcttgtttggtgtgtttggtttagttttctggaacgttactagtaatcgccaagactctgcctcttcctttcaactccacaggcaaagagtgcctggctttgtcaatcttctgttcttactgatgattccctcgttctgcttaagttagatatactttgatcaacattgaatagtacttcagttcttattagttcttattaagtttattacttctaataaatttagtaagaagtaaaaatgtatttgaagtaataaacttaattttttgtctgaaataatgacttatactgctggaaataattcctaaggaggtgtttttatagtggatgggttttactagtgttgactcagttagacaaaggccatgctctcacatatttttgagataatcgtttctccatcttggactcctgctgacacttcagagggacaatgctccttatctatctagttgcatcagttgataagatggataagaaaccctcaatttcttgaaaagtatcctttctgggacctaatacttgtgttctgaccttacagtcactctgaggtttcagggcatggctgcgcagccacacgctctgcctttcctgtctagaatgcttgtgcagctgtagcttccaaatggcagcctcttttgccatctgcagaggctgagaagtttcaaaatcacccagccctgattcctgtttgtttgatagtcctcccctcagtttatgtctttcctatcatgttttagtatcagcagcaagaagaaatcaagtggcctcttggacacatggcctgcaactctccttagctgtccatctgtgtttgtcgctgaacaccctgcttcctacctaatcacagaaccacttctgctaagcttctgccacctctttcggtttccaggaatatctctagctctttccaagtcccatcaagagtatccttacaagatagatttctactagcagtctattcgaggcacctgaggccttctctatgacactccccaaaaccatgcagctctgacccacaacccggttccaaagctgtgcccacatttgcttcagcaacacctcatgtccaagcagttgactctgtgagtaaaaattcaagcagagaagcaaatccactaggatggagagaaatgtgtgggcttagatcagggaactggctcacatgattggtagggctggcactatatctgaattctgaaagacaggctgttaggaaggaaagatagggatgaggccaggctccccaggaagaggtcaaagctgctgtccacaggcaggagttgctctgtaagggaaattctaagccctctttgaagacttcccaactgattatgtaaaggccagacaaaataatctccttaacttagtcagttaataaggtagtttaattatgcctccaaaatcccttcacaggagcacctaagttagtgctggattgagtaactgggaaaggtatgtgtttatttcccaaactatgtatgtgattttgaaatatttagtagctagactaaaaagggaaagagaaacaggtgaatttaattgtaataacattttatttaacccaaatactcccaaatagtatcatgctaacatatagttaatacaaatatgataatgagatattttatatattttctttttttcatactttgttttggaaatccagtgtgcattttctacttagagcatagctcatctcagaccagctgcatttcaggtgctcagtagccacgtgtggctagcagttgccacatatgacagcgcaagtttagacatttacagttatgattttcttcctcactatgaaaaaccatcaacacccttgtagttgtgaagaggagaaatgagcccagtgagttgtgccccacttcctggctggcatccctctgtagaacactctttcttcaattaaaatacgtaagttcctcaggttggcaacttttaggaaccctgagtatgtcaccattcccttttttaagtagcgtctcaatttgcttccgataatggattcatccattagagaagaggtgaaaaacatttataaaagtggagcttttataactttttataaaaagataacgttatatatctacagtgtccaggaaaatggataaatcctacctaaaacagactacagggaatcgttctttgctgttgacacgttcggtacagcagggaccattttccaagttcatttgtcactcttccattaccacaaaaaatagtatcagaaaagacagcattggccagcgcggtggctcacgcctgtaatcccagccctttgggaggccaaggcaggcagatcacctgaggtcaggagttcaagaccaacctggccaacatagtgaaactctgtctctgcagagttagctagacatgctggtgcatgcctataatcccagctactcgggaggctgaggcaggagaatcacttgaatctcgaaggtggcggttgcagtaagcagagatcgtgccactatactccagcctgggtgacaagagcaaaacttcatctcaaaaactaaaaaggaaaaaaaaaagacagcatcatagttttgaattttcctgattcattcttagcctctaaaggtggcctgataatgatcgtttctgccacatattctcaactcaaccgtctatgaaatgcaataaaatgcccctggtctgaacatcaggtccattctgagcataaaggtattccagcgaggtgcatccaggaaggactgattctcaaggttcctattttcatgaagggactgtaactctgaagtaatgatcatgccttctctggagcaggaatatctgatggaagcattcgataaattgcagtgagtcagaagtgatccttccatctggaggctggtgtggttagccaatgcttacattagctaattagctctgagaacggggggcaacattaccttttcttcctgttaccaaacagatgaatggttgtcatagctcagtaattatacaagtgattttgtttggaattacgcttacttcatttaggaatatgaaaacaaccattatgattttttgcagggtaagacattacgagctgtttaaaactgtatgagtatctttaactggcagtagatttttaaaataagcaaacaaagtggagagaagagtatatcgttctatttttttaagtaaaatgttcaggctggtacttcattccatcagtctttaggggcgatttatgtagagaacttctttaatgctaatgcactttgatctgtagagttaatattttgagttgctccctgagatgaaaagccctctaagagaaataaagtattattgccagttgtaactgtggttacctgtgagctaattggagccaggcagagtcagggaataaagttattattgcgttggaatttcagatgaggttagctaaaaattattcttaatttgtgaactcatcatttaccaaaaacttttacagctttttcttttccattggtgttttctgcccttgtagaaatgaccttttaaagagtaataagaagatcatttaccccgaaagatgactcttctttataccaggttatagatccagtgtcaggataatattttgtgtatttgatcaggtaaccactgtctcagagatttagacagaagaacacacggttaatttttaattcctgtgaatttggagaaatttctgctgctgtttcctgactcctgaagctttatactttttacctgaaggtcacctgggagaaaatatatttttctccttattatttttactaagttattggcaataatatagttttgtatcttatactactctcatactctattgacatcaaagaacctgaaagctaaccttaagttggtgctatttacattcctagagcttgccaggggtgtttctctcctaggattcttgcatttggtttcccctctctggagtatccgcctccccccaggtatccctgtgactgtccatttatgccgttcgtcaaatgccatctgaacccacgtccttccaaaaccacttcttacagagcaggccttttccctcactttacaaatcttttatctgcctttcttcaaagcagttttctccttctgacattatatgtccatgtgtttgttagtttcctgctgaaggcaagaaacttagttttgttctctctccgccataccctcagtgttcaactcatgatgagcactgcatgtatactttttttctttctttttattttcttttctttttgagacagagtctccctctgtcacacaggctgtagtacagtggtgctatcttggctcgctgcaacttccacctccctagctcaagggattcttctgcctcagcctcctgagtagctgggattacagtcacctgccaccacacccagctaatttttgtatgtttcgtagagacagggtttcaccatgttggccatgctggtctcaaactcctgacctcaggtaatccacccgcctcagccttccaaaatgctgaaattaaaggcgtgagccaccacactggccttgctgtgatatgtcaggccatgtagtaaatgctttattgtcttcttttattcaatccttagagcaatcataagtggagttatgattattctaattaaataagctgagtggcttaaaattaaataagttaagatgagacagctactgactacctaagccaggcctggaaccaggtgtggtgaaggaaaggaagttcttagcctctgtgatatattatcttcattatggttcacaatctggacgtaaaatttgtgcttgataaaaatgatttctcctaaaaacatatgagaaataggctatccaatgtaattataaatttgctttaaaaaaagcttctaatgcgactcctgaaatcccactaatttaaatttaatcaattagaatgtttcttctttcaagtaatttgattaattgagtagttactatagaaccataagatttcctggaattgcatttaaataaacagataagttattacttttattaagtaagataaattgcatgaaacaaacctattttatacttaacaaatattcattgattaagtggataaatgtcaaaatggcatgcattggcatccaaaattggtcatttttcttctccctttccactttccctcctgacgttttatattttcaatttatcattctgtgaattctagttttactggggagacagaaaagatgtaagtgaaatttgagtttacaggtctggaaaactgccaagcaagtaacatcaggtgtacattaggtcgtagttattatccaagtacctttatcaagcatgtcggtgaattttactctctattagatgttatatttccaagaggcaaggcctttgcaagagtagaaagaggcattctactatagtttgtgtaaacgtgcgtctacagatatccacgatggcaacttacggagagagatcttgttttaaaaactggcttggcactggtatactgtagttacttaattatgctggttaatcacatacttcgttgactaattgaatgcctgtttagcacagaagctaagggaaggaaagaagtttccctgcctccagggatgctatgaaattgtccagtcccagtcagaacagtttccctcggctgtctcctgtgtgaggagctgcccaatcggttctttgcatgaagtgaaaaaccagcagagtccatgagtgaagagagaggcaggtgataaactttcatacgtctatgtttctgagtcagaacttatggcatcgtttcgtgacctcccagaacatcagataaatttgtattcaatacagccccccaataggcgacaaagcaacacggatatggtttttagataagataatggcagccatccgcttcctttgcaagggcctgcgtgcactgccgagattttctcgacacccattattcttcctgcctcgcaggctgctgtgcccttcccgtctaactagaggatttctaagggaggacagcaggcatccctaacagatcatcaccaaagctccctgagcaaggacactcactcattggatctactcagtacaaagctcagccctgggtcatctcttctttctcagcctgtcccattttcttctctaactcttctttttctattttccaaatacctaattttttaaagcgtaacatatggtagacatgagaaattatacccttctggtgctggaagctgacggagggaagacagtgggtgtgctagatggaggactgtatgttggctcttctctctccactatgaaattcagagaaattaatgtaagctttcctggcccaggtaataaggtgagctgcaggacagctaggggacaacagacactctgttcaccaccgtgtggacatcggctggtagaaatcacaacagctcaagccacagggtggttgtttaataaggtctctacacatgcacggctgaacttacggtagttgccatttgaaaaactgagggtgattctgactagtagaaaaccctagatgcaaggaggcaataactaaataaatcataacgagccaaatagggggcgcatcatcagatggtaaagaagcagatgattaggttggagaagatttagaaaggcaaacattgagaaagtagcacaagctttcaacaatgtcctaagaaggagggttagaattacataattacagttaggttatgtgacttaaggctgttacacctattcagaagctatgctaatatttattgaggaaacaatcaaatgctaaaaattgttctaattggcaaagttaaacaaatgaacaaatcagacacaaatctctggtctgaatattcccaatattcattttagatgaccattttgatggcttaataaaaaaatggacaaaaaataaacaattttttattaaaatatgttgcaaagacggacagagatttctaaattaaaaaaagaaacatgggttaatttgaaagcttttggtaaagaatgtctctgaaggaactgggtccatgacttgctttgtgtgaaacttggtacttcataggcctgaaaatgtggtgacgggctggcttcctatgcatattttattaaaagttacttcacaaataaaatatgatgcatgagatgcatttcatgagatgctggtagccaattttcataagccaagtgaggggccagcttcacagcaggcacctaggacacaaagccatgggcggggccagctttagggatctttccggctgggaacatctgggccaatgacaggctgagcccaccttgtcagtaggattgtaacaaatgactttcccctgcagatgtttttcagatgtactttttaaaagcttgaaatgcaggccgacaatgccaatatggttacattgcttcacaattaaatcagcaaatatttatgaacgctacatgatgtttataacagctgttaattatgaagtgttaaaaagtaggaaaatgcaacataaaggtattacaactcagagtttattatcacttttttcaaaggttttctagttggataatgctaatattagagggctttaagatttcacatctaaagtttatgatcctctctgagaacagctcattaaaacagactcattagagagtgagatattagtgtataagaggggtccatgttttcatccagtcctttgtccagtgacctttagaccaatgacacacctactgagtttcggaaacccagttatgttttacccatgtttgtttttcatttggacagtaaatgccagcattttaaaagttaattttaacacacttatcaatgtagaataggtcaattttagctaattatttccatagtaagtaggaagcaactgaacagttgtctcaaattatgttgtcccattttcacatgtctaggactgcagcgtggtacacagtgctgaggagggacaggtaaatgcagaaagaggacagttcctaaggtcagggaatgcataaccatttaggagagatctcagatgaacagtcacagtagattacagattaaagaagcattatgaggaatagccatgatttgtattattattattattattattattattattattttgacatgcatggaagagagaaatgtctggttcttgagtccctttggaaaacctgcgttcagtggttaattcttgtccccccacaaagtagcccttgttaagtcacaagtcctgttgtgctgagttttgtagctgagtctgctagaataataactgacttgaagaaagggttaaactcaaggaatgaaaaaatagaggatgggctatgacgaggattaatccttcctatgaaaaatttttgtcagtttgtgtcataggatgtcttaggaaaatgaagcagaagttctcttacattaatttcttcttgtgaaattagtttcttctgctcctttctgaaacccagtttaaattatgaatgttaaaaccagagtctctgctgacattatatttctaaaatatgtgtattgatttaaaaaaaaaaaaactcctttcataaactggaggccaattaaattatttttgtattccagactaagttgtatatatagaattatgcaatttctatgcttcactcagtctttcatttcaactttaagattttttttatttttaaagtcaccattcctattttctttctttaaacttgcaataaattttaagttcctatttgcgttgtgctgtaaagaaattggtatagtttattgtagaatagaatctaaagctcgaaagtgactttggagatcatctgctccaaaacccttttttaaagttgaaaagacacaatttattggaggtcagacagtgtaagacgtagctgagatggtaactctggttgaattgcactcggcggtgcctttccctctatcttactgcagtcgcacacaattaggtgtgtatggagactctctgaacaacgacacctacgtgaacactctgagtcacactgggatttgaaatgggctactttggtattgacattgcacatgaggctgtcatctgttagatcctttggtgagtggataggcctttgggaaaaatgaagtgtcccagcgtaacactgcagataccaagcaaaagtcctgccggctgagcaatccacttgctgactggagtccatgccccagttggagtccatgcaccatttttttttttttttttactgtgattagataatagctaacttgaaatttcccataaatgttatgtctttaccaaactgacacaatgttgtagaaaataacgtcgtttctatgtgtttccagcgagaacatgtggatccaatctgcgtgggcccagcggcgtcattacctcccctaattatccggttcagtatgaagataatgcacactgtgtgtgggtcatcaccaccaccgacccggacaaggtaaggctccgcctccaacccctgtggttaatgcacacagcactcttataggatctattgttgaagcaaacagcccagcaaatgctatccgtgcttacactttactgtttgaatttaaaagttccagctgcatcctgtgtctagatgccacattcattgcagagcagtctgagattcagatgcaaagtgagtattctcactgtggtgccatttagtgcttctggagagaaagtctacattcctcctttatgtatcatagtgctttctcttatgtctttttcaactcaggtctcatccactatattacaagctttcttaaataccacagtatttatgcatagtatgactaagtgttagaaatgctcctactatactcagacacaaaaatactgtcttttggccgggctcagtcgctcaagcctgtaatgccagcactttgggaggccaaagtgggtggatcacttgaggtcaggagttctaaaaccagtctggccaacatggtgaaaccccatctctactaaaaaatacgaacaaaaattagctgggcttggtggcaggcacctgtcatcccagctattcgagaggctgaggcccaggaatcgcttgaacccaggaggcagagcttgaagtgggccaagatcgtgccactgcactccagcctgggcgacagagcaagactccatatcaagaaaagataaaaaacaattctgtcttttgaattgttttctacagttcatgtgtttcttctcataagctatatacgtttttcaagaattaaacatctgagcgtgttttcctctttcttaaatactttgtgtaaaatatatatttcctccagggtagtaatagagggtaatactgttatttctctgtaagtttgcatacatagtttgcaattatgttactacattttaaatcttaggatagaaatcatactcataatcatgtttcattggctatcaaatgaatttttttaactccttttaagttcaatatagatgcttgccagtaggaagaaaaaataaggtagacatcttcatattgatttcacttaaaaaaaactgtgaggaaactattataggtatggatttcactaaattatgtaatattaaaataattatatttatagtaatattaaatttactgaaccccactatttaccaattattgagttattactaacagttctgtgtctaagtgatcatctcttcatttttacattttgtcaaaatatccatcttatttatatagtttcctctcaaagctgttgggttgccagttctaaaagagaaatgttctgattttagattccgtaaagtgttcatcacagatgcctttggttttggttggcttattttagttctaaaatctcagttattatttatgtaaaaattcaagctttaatgagcagagctgggtaaaactccagggcgttgcaggctttctgaaacactgaggaatttctgggctctctttgctgtgacaaaagcctccaagtttgattctggtatttctcagtatgctagagccgtgttgtaccctgggacatcaactacagtggtacaaaccttgttttttctatatgctactcaatggtttgttactcagttttttaccaagaaactattatttttcagtacttgcaatcatcactttaagaaccagctctgccacttagtagttgcatgaatttgggcaaagagatatagtaatagcatttaccttagagaatagttgtgaaaaacagataaatccacatgttgcgtaagtaaatgtaatatcattatctattataagctgctaatactggtagtgtaacagaaacaagcataagataaatagaaaaaaacacttattaacaatttgttaactatttactaagccatctcattaatttgtctaacaaaaaagagttttatttcaatttgaattaaaattatatagtatataactagtttattgataattatgtttactaatttctgcatttacacacttttaaataattagaatattctgtttggtctccagaaaatcatatgatattgagaatttagaaaagttctgaaggttagatagtagaactttacagaggaaatagctgaacaattgagtttgtttgggggctatattaggtgttgacttgagttaagagtaaatagattacatgcatttccataggggctcaaataaaagcaaatattttatattaaagggattgagatgtgatcgagaccagaagtatcccattgcgacattttcaaaatacagaattatgttacttctgcaatttgagaggcagaaggaactcttcttgaatttcttttaaagaaaacatagctaaaaggaattaattagatcaaatcaagggaatggtttagttaacctgtgtatgttccaggtagttttatgagaattgcatgaatctatcacaaattttaaaagtgtgtgaaagtggagattacataaaattagaaacgctgggcaggagaaacacagcaatcaggggctctccaggaagctccctgcgtctgctgcctgtgatgaggttgctccaagcccctctcctgcccacctccctgctcttagcccgcttcacagtggcagagcctcagccctccctcaactgctccctgaagctcctgctttctgccccaggctctgccctcagagtttgcaaagcctgcaggagtcttctcctccttttgacacagccccacttggactgagagggggctcccaccgcccttcctgggtggagaaggagtgctcgaatgcgcccctgtaatgggtcgggcagaaaactctgaggtgaattctcacagctctgcagccatccctagcaggatggagccaaatgcctgcagggacaccgactcagtataccactcacaggtggaatttctttccatccccttctttcgcgtcttttgaagtcaaatgaatgggctaccgtttaggaaggctgcgctttagggggatccacgaggagacgaacttgaacacgcagtaacttcacttcttcctgtagccctttcggtggagaggacggaagtacaccctaaaaggtttccagaaggagacgtgagacgcagagtttggaatctaatacagtacttcagatgaaagatgataaggtctgaaacagagcagacaccatggagtggtgcaggggaaattgccccagacggagacttagcaagactggagaccttccagcacagggacggaggaacacaagaccctcaagcatggggagggaggaacacaggacccccgagctcggggagcgcagaacaccggattcccttggacctcacacccctgcaggcttccccctgcagctgcctccagtaggtgccgtgggtgtgggaaacaggagagagagagatgacgccgtgggtgagagtcaaactcgaggcaggtgagcattcttgcttctgtcgcagaggagtcttggtaaatctctgctgtccttgaacagttactaacaatgcctctactgcattctcaaaatctttccagttcagaacaatatatgttctccgtacctttaaccagggaacagacttcaggaaccaatttctttatgtaggagatgtgtatgctattaggcacagagatagcaaggtgcctactgtccatccaagtccatggaatgggcagaggcacatttagaattcacaggtgtgttgttagccgaggaaaccagaaattaggatgacagcatgcagaaagcagaatatagtccaagaaagccttgttgatggcgttggttttctctcatagtcagttggaggtaaattttgcctcagctgtcgtgagaatgatcttccacctgtaagtgccattacagagttttaaaagactgaagtgttttgccctggagtggaatacccacagtttccactttccaaattcatttaaatccagattatacatcaataatcataaatatttttattctatatgaaagatgtgcctatagcacattttagtttctattattttcctacacatactagaataattgaaattctatctaaaaagaagcttagagttcctattgtttaaaccttttactacttgacagagaggaagtcaagatcccggaaagtgaaactccttgtcgtcccattgcactgtgagaacgctttattagcttgcttgctttccaccataaataaatgaaagaacaggttattttctacctccatagggtatttttggctgtaactaacagaagagccaactaaaaaccgaaagtttgggggataccttattttagataacaaaggggcagagtcagggagcttccaggttgtattcagtagctccgtgatagcattgcagctcaggtgtttgacatttttcctgccccctctctagagcggagacaatatttcccctcagttctcaagacgtctgcaaccacctgaggctttagttcccgatttggtcatgtttaatgaaatgaggcatgtttggctagagatggaagacatatttcctagaatttgtctgctgagttccttcatatcccattgcgtcaaatgcctgtggtccaattgccacggagccaaggaaagaaatatctagaagccaggaagaggagccgacggttagtgtatggtgaccagtgatatccatcacatccaggcaagccagacaccaaggaaagaggttggaattaacactagtatatcttttgcatatgatgtgattccaatcacagtatcttccttttactttagttttatggctaacatccattaaaactcatgatgtatgttctttgatttcttaaagtggacttttaaacttgtccaaaacataaaatgaccagtaatgaatttaggcagcttgggtttatacaattctcttctctccttttagaagtttattttttctctctcatctttgtgtacacttatgcagacattgtatatattttcttgattgtgaggacttaataattaacacattaaatttcagttattttgtgttatattgcttcagaaaattatttgccctttgtcatttatctcggagaaatgttcagagaagaaacaaggtattccaggttgacatacccgcacaaccaatactcttagcaaagcaccacttagacacctgaaggcatctcaattaagcagaattaccatccaaattaagcagcagccattgccattaagtataattaggcttaatttgattccttgggagacattccaagtaagtgggtttctcaattaagtgcacgttgatgaaagtgtattacgtattgaacataagagaaaagagaaacagttacataaagtttccatgcaatgactcttgccagaagcatcagtgaagcattttggatgtgaagaatttgcatacttcaatttgtgtgtttgacctggtctgcaaactttaagaaataagataggacagaaaagcagtttccgacgccaattctctcttagtcaatacaaacttctctttttttgaaacatttaatcctctcttgattcatactctttcctagtcttatctcggctttgactgttgtataaccaagtgctgccatggtcagtttattgcaagtatttatgtaaaactcctcatgcaaaataattacttgcggaatcttagcatctccctaataatgcacatcacatgttatcatgctatatcatgtcaaaaggaacacgaaatatctatcgttagaaaatctaaaacttttagaagaaactagcattttctattcaggaagttataaaatgaaaggcctctcaagaagattcctttagtggagaggcagatttttaaacaattggaacagctcataccagggtattctggtagaaagtcaatgcaaagtaatattatatgatatgtataaatatgttttattgtagacacatttgacaatccagctattttcagaactcttgatgagtcctgcaatcagaattcttgaaaaagtaatatatattgtgagacatgtgttatagtaattaagataaaattctctcaaaagtttatccctggggtcttcattggaaagtttaaatgtatcatgaaggacctaccttctactgaataattttataaagtttatccccagggtcttcattggaaagattaaatatatcatggaagacctgtcttctactaacatcttttaggtataaatgtatgcatgcatacatatatatatgtgtatatatatatgcatagataaacacacacacctatatatacacatatacagtatatcagctggaatgagaggtgtgtgttctaagttaaaagtttctgttatatagctctcaaatacatataaagataaatacattgatatacacacacattttaaatacattctgtggtgacataatttcagctactgattctaatttgagcttcttgtgcaatacttttgttgctattaaagctcattaaaaactctgaggatttaaaaaactcaaaacgttagtacatcttactgatttgttctttgtttagttttctttttctttgtttccagctttattgatgtataattgacaaaaactgtacagactcaaggtgtattatacaagcacaatgaaatattactcagctataaaaagaaggaaattctgccattgacaacagcacacatggatctgacaggtgttctgatgagtaaaacaaaatatgtgaaactttgattagggaaataaatactcaaacatccacaacaattgttttgtttggcaagtgaacatcagtactttataaccctcaaaaagactttcatatgaattttcaagtatttaattataagtttgttttattatatatttataatggaaattataaaattatttttaaacatattaagtaaatcaatactctgaagcacatgtaattctaatagtggcttctgtcagtaccaacttttctaaggcatcagatgaattcccacaaatgctggatgcctgcacagtcattggtgggtttccatctccggcgtccatggggatgtcaacacatgtgtgtgatgatgtgtggaaggaagaaggagagtgatgaggataaggagtccaactatataatgagaaagcagaatcatttaatacagcaaatagtgacggatctgcagaggatgttcaagaaaggcaagtagcagagggtgtgagggaagggggcagagaggtctcagaggatgtggaggaaggttggacgttccagaaattcagagaggggaaataaccagtctttctgtacagttgcattgcttgggaatattgtcggtaaacaaggctgggaatttgagctgataccagatgataggtattataggctttttctttctccctttccttcctttcccttccctttccttcccttccctttccttccctttctctttcccctcccccatccccttccccctcccctcccttccttcctttcttccttttgttgttttttatttactttttatgtcttcatttatatttttatttttattttatttttaaaacttttattttaggttaagggatacacatgcaggtttgttatataggtaaacttgtgccatggtggtttgttgtacagattcatcacccaggtattaagcccagtacccaacagttgttttttctgatcctctgcctcctcccaccctgcaccctccagtagttcctagtgaccattgtttccctctttgtgtccatgtactttcaccatttggtgcccacctagaagtgagaacatgcagtatttggttttctgctgctgcgctagtttgctaaggatactggcttcatccatgcccctgcaaaggacaaaatctcattctttttatatggctgcatagtattccatggtatacatgtaccaattttctttatccagtctaccatcgatgggcatttaggttgactccatgtattttctattgtcaatagtgctgcaatgaacttatacctgcatgtgtctttatgatagaacaatttatattcttttgggtatgtacccagtaatgggattgctgaggcaaatggatttctgtctttagatgtcaggaatcaccacgctgccttccacaaaggttaacctagtttacactctcaccaacagtgtataagtgttcctttttctccacaacctcaccagcatctgttaaattctgactttttaataatagccattccaactggtgtgagatggtatcttattgtggttttgatttccatgtctctaatgatcagtgatgttgacctttttttaatatgcttcttagctgaatgtatatattcttttgaaaagtgtctgttcatatctttgcccactttttaatggtttttttttcttgaaaatctaagttctttttcaataaaccttcacatcctctatggacaaagggaggtgaggtgggttgggtgtaccggggctgagcacactgacagcacaccaggaggggctggtggaggtgcaggaggagcggtacggtggtccctaggtacagtggtgcctagagtgaagggatggctgtatgtcctgggtccgttcgtatttccttttgtattaactctatccacctttaaattttgttgtgaggaatatgtaatcgatttaaagcacctagaatattatttgccaaatactaagtcctccaccttcttgttattcttttcttcaactcttcctcctcatcctcctttttctcatccccttcctcttccctctcctcctccttttccttgtcttttctcccctttcctttctcctctctttgttgtttgcctcctctcctctttctctcctccatcttttccctctccttcttctccgcctccttccctttctgtttattttaaatgactagggtcagaaagatataaacagggtcccgtatgacaggcaaagagtttatgttttattctcaaaggaaatggggtgtcaatgtattatattgatgaaaggaatggcatgagaatgcgtatacgttgggaagattggtccgcatcacggatggcacaaaactggaagcaggaaaatctagagccttattctaactatgaaagatgatatgaacctaaatcaagatgcttgcatgtcatttggggagaaaaaaaaaacaatatatttgagagatatctcagggttatgtaattagtcacagcaatttgtgtttttacactacacgtttcttaatgaacaactgctagtaaataagaaaaatttgctttaaacttaatgcttgcaagaaaatcctgatatgtttatcagatctgttttagggaaggagctttaacttcttttatgattcaatggtttttttaaagaacttgaattaacaaattcagagagatgaagaagaggcattcacttgcatttgaagtattaaaaggttaacatagaaacctatgttgtatatattggtttaagacattttgaaatgtgattggaatagatatggttcagtagactttattaaggaggcgattcacggattggtggagaagtagagattagacacaccaccctttcctataacaccgaagggagcctccccattattcaatcagacctttccccgtgcaaagacacagtggctccaccaactgccctgttcacttttctcccatgccactggggaaaggaggacgcctggccaacttgctttgacagatcccttagttcatcttggctgtcatcattaatctatctatctgtctatctctctatctatctatctgtctatctatgtatctttctttctttcttgatctctctctttttttttttttttttttttttttttttgctgtcttgcactacagagttaagtaagagtattttttttcaatatttattttaagttcaggggtccatgtgcaggatgtgcaggtttgttacacaggtaaatgtgtgccatggtgctttgcttcccatcacctaggtattaagcccagcattccttagctattcatcattaatcttatggcgttgatccatgattgtgtccttgtcaactctccaacatatttgtctctgtgtgccagctatttcattgtctatgacttacccgttactgctgcttaacagttgcaacttttttcataaactgagtttggttttggtgactacttccctctcacacctctgtcatcacccctttcaagatcgattgtggttttttgggttttttgtgtgtttggttggttggtttttctgccacaagggcacgtacattctccactttctgctggattgattttcttataacacctcagttcttaactttcagaactaaatagatttatttttactgcctcctcttggagctgagaaataaaatggagaacaagggccatgcttttgatttgcttgcaaacatgtattatacacacacacacacacacacacacacacacacaaatatactgtggagccagcatttctaagaagactaatcccttatcagtgtacaacgtaaagtgttacagaggtaaagaataacagcacagctgtagacaatagacttgcaactatttagcaggtgtgagtgaatgaatgtctaggtttgtgtaggagttatttatggacactgaggacgacaaaacattcaaaaaacatcctgggagaaaagtttacaggatttactccgtttcttttttttcttaataaaagttgcttaagttagggaaaaggaaaaaattctagtattcaatagtagagtaggaaaattatagttaatgataatttattatatatttcaaaatagctagaagaaaataatttcaatcttccaaacacaaggaaagatacatgtttgaagtgatgagtattcctgttacactgtttggtcattatgcatcatatacatgtaccaaaatatcacgtgtacccccaaaatatatacaactacaaatcaaaataaaagtagcttaaaaagacagaactttaatgatcgtatactcagaatgtacccaaaagaatgaacattagtattcatgaaaaataggtttaaaaatatgttggtgtgtttgtctgtttttgtttttttgagacggagtctagttctgtcacctaggctggagtgcgatggcatactcttggctcactgcaacctccgcctcctgagatcaagaaattctcccccttcagcctcccgagtagctgtgattacagatgcctaccaccacacctagctaatctttgtatttttactaaaaacagggtttcactacattggccaggctggtctcgaactcctgacctcatgatccacccgcctcagcctcccaaagtgctgggattacaagtatgagccactgtgccaggccaggttaaaaaatgtttttacttgtgtttttgttttgtttttttgtgagtaagaggtgtgtatttatatggtttaagatacagggaggtgtaaatacctattttctttggagctcagttagttttacaggtcttagatgtggtccttttttttttttttttttttttaccttttaatacgttacctattttatgcatttgaacttttttttacaatttttctcatttttagtatttgtcgtacttaaatacaatagtaatgatatgagtaacaacaaagcaaaaccttttatattcagcaattgtttaaattacacacttttagataactgggaaggagtgtgagaaaagtcactaaaatcccggtttgtgcggagatgtcactttagaaggaagacattagaaaacaaacaaaaaacccaactaaataaaacgtagtcacacagtgccaaatacattaggacaatgaaatagggggaagaaataaattcttgaaaatatttataaaatgaagaaaaattacaaccctgtataattcctcccacccagatcatgaccaagcaaagaatggcattgcattctaaatgcttctactttctctttgacttcatattatcttgtgaagagttttgggctaatagaatgcaattaaaaataattactaaatggatggtttggttttttttttaacttttaagttcatgggtacatgtgcaggtttgttaaaaggtaaacttgtgtcatgggggtttgttgtacagattatttcatcacccggtaaataagcctagtgcgccttagttgtttttctcgatcctcttccccctcccaccctccaccctccaataggctccgtattattattatttttaaccaatcagttgtttaacatgtaactctttgtgattttttttcattattaactataatagtgtctttaaattcccagtggataaattgtttcacagatccaggatatttgccttcagaaaaatttctagaaataaaattttactgagttaaaaaaataagcatattaagggagagttttaagtggggaacttttgattttgccaagcaggctaaaataaattttggattgctgtggcactcatctgtgttcaaccttaatgtgtgtgtgtgcatatatatgctgtgagtatgtgtatgtgcacgtgtgtgtgcatgtgtgtttgtgcatgtgtgtgtatgcatgtgtgtacgtgtgtgtgtgtgcatgtgtgtgtgtgtcccattagcaatactgaccaagatgcagatagaggaaaggagggttcccaagtctttctagattctaaaactctctcatcagttgatgttttgtggcctccatgccactagagttcctttaacaagtatgatacaaatctctattctacatcattattttaacattcactttccatctttccccacctactactgtattatttacagtggattttttttttttttgtgggttggattttcttttccctcatatggttatgttcatctgtaagaaggtaccgaatttttactctaaacctgcagagtgttttatgagatgggtggtagtgatgtgtaaagtcaggactcctccttcacaaagtttctgacgtagcagataaggcaagccctgcagtgcacacaggcacacgcagctcacgggagatcatctgcatccctcgcttatgcagaagcctctgggcatggcttcctctgtctgtgaatgctagcccctgccttcctggagggccatacatttctccttcctcagtgactaactttatagatactacttttttttctttttctgtttttaattttacttgttaaattttttaaagcgggtatatgtccagttttgtcacatggatacactacatcgtggtggggtcggggctggtagtacacccatcacctgaatatcagcatggtacccaatgtgcaattcttaagctttactctcctgcctctctcctcactttcggagtgaccagtgtctgttgttgccatccttatctccatgtgtacccattgtttggttcccatttataatcgagaacatgtggtatttgactttccatttctgcattattttacttaggataatgacattctgttccatccatattgccaagaaatgtatcattttatgattgtgtggtatccatggtgtaaagataccgcattttctttatctgatcaaccattgttggacacttaagttgattctatgactttgctattgtgaatagtgtataatgaacagaggagtgcgggtgtctttttcgtagaatgatttcctttcctttgagtagatacctagtagtagaattgctgagtgaagtgggagttccagttttagttctttgagaaacttccatactgttttccatagaggcttactcatttacattgctaccaatagtatttgctttctgcacatccttgccaacatttgttattgtttgacattttaataatagccatgctgactggtgtgaggtggcatctcactgtggttctaatgtgtatttctttgatgattagtgatgctgggcattttttcatgtgtgtattcactgcctgccgttttattgctgttaaataatgagtggtcactgtaattttcactgcccattgggatgctctgtgaatctggattctaaatacaacgtgaggcgtctgtaacatggaagtaaataggaactggaagaatcaatcagtaaatggtgatgaaattctacaaaagaccctttaccctaagccattgtgttacagaaggataaatgaaattgctttctctagctcgatagggtcaaatcaaggagatatatagccaaaaaagttctcctgaaaggctgctagtgataattaggttccactaatttatgtcaaaaagtaccctgagagaaattcatggtttccatgaagacagtaaaagacaatagaaatatctaggtttttatatcatcccgccatctcattcccccttttctctagcctttccattccttcttcctctcccattcattttaagagtcatttataactcagaggagctgccttttctcaaatacatgctttcaaggtctaggtttcttctagggcactaatacagcatgagaagaatcagtctggagttcacagacctgggatcccatcttgactttgcccattttgcagctatttcatcttagaaaagacactgaaattcttgactctcaatgtcctcatatgccatataactgtggtgatgataatgataggtaccttcactaatggtatcatttctgtgtttctcagagaaatgatgcatgtggaaatgcttctaagtaattaacagtactactgttaatattatccttctattaatataatttcttctttggaccttgaatttctttgcattccattatttcaagggctcttcctgtgccttacagagataagttatataatcaactttgctgaacccagcactacaagttcgaatgggtcctggaatctctgggtgtcttttctagtgaacagatccagaaaaaaatcaattgtctctcattcaccaaattccctccacactaaatcccttacgctggccactcatcttgttaggaaatccagaaaacccaccttcattccgcacggctttcctcctctgtcacctccagctgagcaataattccttcacctcttgaatatcttttgtcttcaacccctcttccattctcactgtgtccactctaggggcctcttagtagtcttgccatatgttttgttttaatccctcatagctgtttgtctctcctcactctccattttctaatttatcttccacaataaatttgaaatgtacttttcaaaaatgtagatatatgtataaaatacaatcaatatgtgatcattattttaaacatgatataatacagtcaaatacgaagcagaaagtgaagaccttgaaatgctttaatctcaagataatcagtgattgtaattgtgggtacttatttttaagacttgtatctctgtgtttataaacacaaaaacccaattcttttcctttatcatcttccatttttcctcttccttctcctcctcgttcttcttcttcacggtgcctttaaattttagatgatgttccacacatttacaggttgcttggcaacgttacaatatgttgcgtatattcccagatgaactttattatttgttttggctacttagtatttcttcccatcagcttactcctttaaacctctgttcagaccatgcctagtctttgaaatcacaaacaatcattccatggcgatcttcatgttcacaccaagggcagttatttccataggacaaattctttgaattggaattatggtaatgttgttgcacatttgaaatattgatacttattgcccaaacacataccatatgctaaaagagagctcatggaagttcctgccacagggtacacacacctgtatttcaacagcgttgatagcaaagttaaaatcagaggatgttattcttcagcataatatccttcaacacttctccatggtcctttacatgtcaccaatctttcatgacaggtcaccagaccaccacggcagtcccacttctagtcatttatcttttcattccaattctgccgtcatactgggctactctgggacctcgaatcgtggtgctgccccaggacgctttccttttcagacaccttgagcaactacagggcggcaggtgaacatggggtactactgagacaccattcatcattggaggagtggacacgaggtgctattgaggcaccattcatcattggaggagtggacgcggggtactattgaggcactattcatcattggaggagtgaacacggggtactactgaagcactattcatcattgcgggagtggacacggggtaccattgagacaccgttcatcattggaggagtggacacggggtactattgaggcactattcatcattggaggagtggacacggggtactattgagacaccattcatcattgcaggagtggacacggggtaccattgagacaccgttcatcgttggaggagtcgacatggggtaccattgaggcaccgttcatcattggaggagtggacatggggtactattgagacactattcatcattgcaggagtggacacggggtaccattgaggcaccgttcatcattggagaagtggacacggggtactactgaggcaccattcatcattggaggagtggacacggggtactactgaggcatcattcatcattggaggagtgaacacggagttccattgaggcaccattcatcactggaggagtggacacagggtactattgaggcactatttgtcattggaggaggggatacggggtactactgaggcactattcatcattggaggagtggacacggggtgctattgaggcaccattcatcattggaggagtggacacggggtaccattgaggcaccattcatcattggaggagtcgacacggggtactattgaggcactattcatcatcagaggagtggacacgggttacttctgaggcaccattcatcattggaggagtggacacagggtaccactgaggcaccattcatcattggagtagtagcacacattccacaatgtttttgcaaaccaacaaactatttatttagggagttgaccgtataacttattatctgatccaaatgctgaaccaatggcattattacccttaagttacctttggagtaaagggtgataatgctattaataatcaacctagaaacaaccaaagactctatctgtcctaggcaaaccaaaacctgtgtcacctactaggggactaaggggaaagtatccacaggtagaggaagctgtgatgtgttttactgtggagagaattgtaaaatgattatctccatgctccaagcatttccgcagaaggcaggagatagggcctcaaagcagaggaaagaaagcctcaagcagtgagaggctgttggggccaattcaggacttgctcacctctaaaaggaaacactgtgcctctttttaaagagtgtttgtttgtttcttaatggtgcataatgagacatgttgtttaaattatcttttcaaggaagcctatgtctaaaacctctttgaatttccagtcttgtgcacagcgtttggcaaatagtgaagacccataaatggtcacgaataaatgatagtaataatggccaagtttggaatgttttaccccactagagaggcagcgatggtctgccataattaaaggtcttttgttaaaaataggtacagctgtctccaagccacgaatcccacaaatctacatattatttgggtcctaaaaatggccaaatatgttgtactaatacatatccagagaaacaaaacattattttcatagaagtgtcttctgaatgtaacacacaaaatatatttgtggcagtgaagctcagtcgtgggtaatatttggaatggatttggccgcctgtattgtgttccattgcacttgccattctgtgttttttgacagtgccattaccctgcagtttccaccaaagtgcagattacaaagaggatactgcaaaggactgggtgctgggttctgcttgacttagcagttctctaagtgaggctttatgtgtgtgtttgaaaactgcatttgtgacctgatgattgtttttgtggctttcctgtgaagtacgaagtgtgctgagatctgtccagagggggtaagccctatggcagtgaagggagaggggcatccaccaaggtcgcctcttttggcagtctttctatgatcagaggctgagcagctaggcttgaaagctaataaagctttgagagaggagaagttaaatgttaagtcatacttttcatttaaaggtgcttacagtagagagacgcaattaccattatcctcgttaacaggtggcacaggcagcccccacgacaatgtttttgtaccagccctaaaggcaatgatagagtgatattgaacttttccatttctgaaagagagagagggtgtgtgtgtgtgtgtgtgtgtgtgtgtgtgtgtgcgtgtgaaaaagaagtttgtattttgtttgataattttggcttaaggactgaacaaattatctcaacccacaggatccctcataaattctttgtgtgtgtgaatatatatatatatatatatattaattattataaattttaaaaatctttgtgggtagatagctaataaaatcaattgaactcatggacatagtagaaggatgtttatcagaggctgggaagggtagtgggggttgtagggaggtgagggtggttaatgggtaccaaaaaacatggaaaggatccctcctaaattctactgtaacaaacaaaagtcttcataattaagtgttacatgtttataaaatccacttaggaaattgatgattctgaatagttcctctgttttgtgctgctgggttttgtgaggagtcttatgtagttagtggaatatggaataatacatacttaagaacatctagagcgaaaagttaatgtcaaattcctctatattctatttgttctgtccttgaatgggattgaaatcaccagttttaatagtctgtcatttaacattgggagaaccagagctattcaaatatttgctttctgggagctgttttaatatcacatttgactgacttctggaaccctaaacagtattattaaaatgctccactatgtatatttcatagaaaaacttttggcaccgaagattttgtctataaccatacaactgtctgcctaaccatacatctatctaactatctaaaattagagatacagaatgaaatgaatgggaaatgaacagaaaactcaaatatgatagacacatattttatttttatgcaccctcacatttaagttatcagattcaagtgtacatgtacttccatatttactttaaatttatatgtaaaataagtttgttctgtagaattaaagaaaatgagctaaacttacacaaaagcttcagtgaagcaagcgtttaagttcacccagctgtggaatttttgcaaatggggctcagtgcatagaatttaaacctgtcagcatcccacttcacctccaccttctgacctgccagggccacctgaccccaccagccctcatcaggaagagcaggtgggatgatttggctaaattcttacagcgttcagactgtcatcatcaatgaccacaccagaaataccctgaacgtgtcccaagaacagaatgaaaacctctgtgagcctcagtattgaaatactgcctaaatcatcccattggcttcatgactcctagctaaatgccctgtcacatttcacaagcactgctcacaaaagctcccgtccatctttccctacacctcccagacacatttctccccattctgcttgttttctggcctaggttttgctcataatttaatagcgcctgccagggtttgcctgtcacgggtcctacggctgcacttgccgagggctctcctggctccttagccttccctggcggaggactcctcacgcacagtcttcttcccttcctcctcagcttatgtggtgtttcctgcttctgacaagagcccaggtgtctgggcttctctttaacacccctgacccacttgccctgtgtggctgcttgccaggttactgttgagtttcagtgacactctcaccactgcagggggctccctgcctgctggctgttcacacagcactcttggcctgcccagacccagctcacttgacacactgttgaaatctcttctgcttactttgtagatttactccctcccccgctctgaagtattgaccctctgtggaagttctgaagctctcaacattctgattaacaaagccaggctgagaaaaaaaactctaacaagctcaagaaaactaaggtgctgccattcatgggctatttctcccacctgctcagatcctctttggcctggccatgctgtgccttgttagaggggctgtagcttcttcatggcttccaacagagcaggagctgggggtaccaattatctcaattccacatttatgtggccttgcttcccttccaccctcccttcccctcaatgtggggtgtctgtgaccctgttctctgctcccccagctccaggctctccccagacccccagagggggcttcattgtcttcctcctcaatcccaaattggttcacagccctcgccagccagcaggtcttctgtagttatttctcactcttctgacttcatgttgaactggtctggacccatttaagatattccctaccacttccaaatgtgttttctcatcagcttgtcttttcactgttcttataaagaaaaacacaatcttttttgccttaaatggctatatccattaaaaacttcttcttgtctaccttctttttgtgtatgtttcacttgtataaaaggcatgagcttagacatgcattaaatacagtcatgaagaacgcataatataagctacgagcacacacatccacatcccatctttcaaaactataatgtttacttattttttttgaaaaataaaatcagtcctagagaaagcaaatttcacccataattccatcacctaatgtacaaattacattctgttttgccccattacgtagaagtctgcctttacatgaccatttaaatatgactgttgtggatatgtatgtgtacgtgtttggcatatgtgtgttttcagtccttttcaagagtgatacaaatattataaatattctgtgaaattatttgcctatttttcacttaataaaacataaacatctctctagatttattaatttatatgtctacttcacatattttaatgtcttcagaatatttgtaactatggacctactaaaattggtttccctatcccaagttaacaaagagtcaagttgttttcaagattttactgtcattagcaatgctgggagggacatcacagttatggtttatgttctgataaaaggtagagctgtaattgttggatattccaagtctgtgccacggcagcaatcctgcttctacagtatggttgatttgacgcagctgtcttaggaatatcttcttcaaatttttttcatagtagggaagaaactgaggaactgaatagacataggatgagatcatgaatcagctgggtctgtcacactctgtctgtttcatgaaacaatttatctaaaaaaggcagttaatgacttctcaaattattataaaaattcctgaaattggctctcatgtctccatttcaccaagcgtgtgctgacggtgtgcctgcagctccgaactatggctacattactgaaagcctacctaggtatcttctcataaatccatgaagtgatattacattgcatttagcacagcctgaaactgatgaaagatattcagagtaggtctttcctttctttttttttttctccttgtccacaatttattttttagctggttggttgattggttttaagaataatattttattgcttgaatatattgaactcttcagtattcttctgcaaaactaccagtaattgacagacagtacgtgacaggtctaaatatgtggtgaactatttctgaaatataaatcttctctgtgttttatcaaaaattataacagatttccgatctccattaattatcaagaaagtggaagaatttacttttgtattaaacaagtaaatcttttataacttaatttaaaagaatataaattatacaattttaaaattaatgaaaatggttcttagtcttctgtattaaaaagcagaactgttcttgtgtcaataaaattcatataaactaaaagcatactttacgtagataatttcgtagtctaaaacttcagacccaaatggagtatatgaacaatgttgatgtgaatactcttgcaacagaaaggatctctgtagcatacgcgttacacttgagtcctcttaattccttaaaataccttatatttgcataaccacaatgccccccaccttatgtttatcttggctaatccaattcaaaaaaacttttgagtctctttagcaatgttttctgagatagaaaggcagttatcacaggtcagaggaagctttataactgcctaacaacaatcccttttaaaaatacacaaattgttatgaactgtttattttagcatgtaatgcttacaaaatgtcatggagatttagttttctttaatttagaaatatgcaaaaaaaaagagaataagctgaccttattttttcatgccatgtggatgatgcatatttagattagtattcaagctttctgtgtcgatacacttttttgtaatttcctcagcccttttttctaaatcagaatgttgtcttttccacagacagtactctgtttgtgcagaaaatctcacctctttctcttagaagatgggatgaattcaaagtgcctccatgtaaaggagattttttcctctcattgttcaaagaattttaccatttgttttcacaatacagaacatgcatctgcaaaatctctattttttaaacatttgctatgaaacttctcgagttcctgtttctgccactgtgagatccctatcagtcctcagctcccacagtggcagcctcatctttcagtagctaaaaccacgtctggactgacacaggtaccacatgccacactcagcatgatcacattaaagacacagtggcagcctcatctttcagtagctaaagccacgtctagactgatgcaggtactgcatgtcacactcagcatgatcacattacagagaacatcatattatcgcagcttgtcacggactttagtatacaagtgatatgacagactacaatgactatttctcatcatcagtcatgtctttattacatagagtaagaaactatacactggcttggtattaaatgagcaccggaaagaacataatgtatcttcagaaaaaaaaaaaaaaaaaatatatatatatatatatacatatttattagaagacaattctgaaaagagagctttaccaatatagaagcagtggttagggacgtaaagggtcttatcaaacagtcacaataaaagttatgtatttggtaaaatatgttcttttctccttagctgtcagtgtgcagattagttaattccagtttactgcaacctaaagcatttaccccctgcatctactcttaggcttaaaaccaatgactcacaaactctaaagtgtgtgttggctttcaaaacattcacatattgatatagagtttggatatgacagtcctgtagtacagaaaatatgccacaagatattagttaatatttcttgagaaatttacatgctttagaaactttaagtaattatgttcattatctcactgaatctttgaacgccctatgccataggctacattagtgtttcctttttaaagataagaaaactgaatcacaaagaggtcaagtctactctcttaactgctaccttgttctgccatgagctctcacagcatggtgagagtggcaattacatttagatttaggctgatcctgactaatgcattgctggagagttttgagaaaggggtctgactgttcacttcaagttgagtagtggtttgtcatctgatgagagaaaagcagagacacatttgcatgatgccatactcctattttcgagtggaagcagagattggcaacatgggaatgcatattgcatacaccctatttacccatatatttactcttccatccaacaagtattcacgaggtgcctgtctgtgacccaggaaggatgtgggaatatgtggtgcaagcctggttggccatgaagcttcttttcaaggaggtgcaaagtggaaaataggcaagcaaacaaatagcaagatttcaggtgtcatagcagctaaggaaagcaaaccagtaagaaaggaaacagcactaggcaaaggggtggagactgatgaggtcagagaaaggaacttagggatgatgcacccataagataagtgtttgagatgctggatgtgctaatcaccctgagtgaatcactacaccttatatgtatggaaacattactgtgcaccccatcgatatgcacagccgccatgtgtcaattaaaaaacttttaaaagattatattgagggctgtctgctgagccatgccttggaggttgtgaagatggggaaggaggaagattggtccaggcggggtcaaggccctggagtaggaatgagtttgctgtgtccaagaaatgccaaaaaggtgggaattattggagaaaacaggagagggcagccatagtggcctggtgacaggtggtgagacataggatgtattctaaaggaagagacattggaatgcctgctgatgggctgcatatgggagaatcgggatcaaaaggtgaagcatggctcctagattttgaggccacgtgcatgggtgatcccaatgggacacttttttatcggctctgtgctttgctttcttttttcttgccttttacttagaatgattttcaatatgaaacaagaaaaatcagagttaaatgtaagaaggtggtcattaaaacataagcaacacatatattaactctttatgtctagatccaagatacctaattatttcaattgcctgaattttctttcaataaatctgcttgttgacttatttattcaaattacatttgttacacttggagcatatgttactccactgtctgttgcttgtaacagaatacctgaaattgggtggtttatagagaaagggagtgtattatttacagttgtggaggctgaaaactcaaagtcaaggaactgtatctggggatcgccttcttgctggtgggaactttctgtagaggcccaaggcagcacacggcgtccagtgttgaagggggctagctagatttctcctagatttctcccatcatgctagctgaggtttctcctcctgtttttaaaaagccacactctcacaataatccagtaattcattaacaaattaatgcattaatccattcatccatgaatgaatttatccatccaagaaaggagagccctgacgacccaagctattcttaatggtcccatctctcactgctgcgacatgaggggctgagtttccatgtgagcctcaaaggccataaacattcaaagcatagcctcccatcatcaggccagagtagaataaggcctagatctgtctatctgagaccacttggcctagaacagaagctggtgagcttgcctgtaaagggcaagataataaatggtttagattttgcaggacacacagtcactggcacacttcgcctttgtggtctccacaaccctttcagaacatagaaaccatgcttatgaggctttaccaagaaaacaggcacagactggatgtggaccgtgagctgtagtttgcagacacccaatctagaagcaaagcaaacatggaagcgggcatctgcatggcaatgtgtggctctgagatggaggcttcagcagagggaagtggggttgatatcagggatggcttcgaggagcaggtcttccttgaaacaaggctagagggtgaggaaacccaggtatattgggaggggtgtctgcaagagcagagttaagacaggacaggcacaggaacacgcgagaacttagtgtgtgtgaccaccaggtgagaaggggaggatgtggactcggggtagggagcgggacccagcccagggagcaccctgcctgccctcctagcaagggtggctttgctctgaaagggcttagaaacctgagaaggtggttaagcatgaaaacaacttggccgggcttactctttagaaacaacccaaattcctatcaatcaatgagtggaaaaagaaaccatggtgtgtgtgtgtgtgtgtgtgtgtgtgtgtgtgtgtgtgtgtatgatggaataccactcagccgtgaaaagggttgaattaatggcattcatagcaacctggatgagattggggactattattctaagtgaagtaactcaggaatggaaaaccaaacatcgtatgttctcattccaagcaggagctaagctatgaggatggaaaggcataagagtggcagggtagacctcgaggactcaggcagaaagggtgggaagtggttgagggatacaagactacaaactgggtgcagtgtatactgctcaggtgataagtgcaccaaaatctcacgaatcaccactgaagaactcgatcacgtaaccaaataccacctgttccccaattacctatggaaataaaaaataataattaaataagcattttaaaatagacaagggctacagagagtgaggaagggcagaactgggcactgagatggctccatcagcccttgtggcttgaggaaggcaaaggaatcctaggttgcaggaaccccccataacattgttacatgtaccgatagagtcatacagcaataattatcagtgctcttctgagcacggtattttttttggtggacctatttattttggtcaaaatactgtcctactttcatggggtggttacccctctccaggaagtttataaactcatttcctttcttttagttatttttttctttaccatatccaaataggttgaagttgtatcgcaaatttctactttatgacatcaggatatggcatggtgcatgtagtaattttaggagtacttcttattcttaaaatgacattttaaaaaatgacctagcgaaattccttttaaaaaactttgtttgcatgtctttaatcattttattttcttttcataaatcttaaagagcaacaagaaaaacacaacacatttctattagataactagctcaagccaaaataagatctattgtttttcatataggtaggcttagtagatttaactccaaagaaaggttgtagtatatttaaattaatattacttacaaacccactttattaacaatacaaaatagtaaacttaatatttaaatagtaaagcaatgtaaataaaaataaagcctaaaactcaattttgtatgagactttggaaaaatattttcttatttgagagacgtgatcaggcataaatatatgctcagaagttggaaaacattacggacaatcattgacctactgatccgtttatacatctgtatatgtacaagaagtagtgttttaaaaactgaatcagttttacctcttcagtgtggaaactaaatggttttgatatttttcgaccgtacaaattttacattctcacttagaaactgaaataagcacacattcatttcattttcttgtcgagtatgactttctgtctttgttcttggtgctcataacacaagaagaggcttgctcacttatttaaggccgaagtcaaagccatgtggccctgttttcttgtgtaagacaaggtattcatctttgccaagcccagagcttgtccaggagcctgtgtgaatggcagcatgagggttggccaacctgtagcccacgttattggtcctgctgtctaagtcaggtctccagctaaacagcagattcagagaaggggccctgaccagccccacatctgtggacaggaggggagacgctgttcagttttgctcttcccttcttccaggaggttttcaaaacagctcaagacctctgatatcctccctccatctaaactcaagcagcagtggaaacattttcacagtttcccttgcaacatcgtttttccaatatttcaccttccctttcatttcagtaataacatcactggaagtaaatgatgttcttcagggagctgcagaatcctgttcaaaaagttcatgtcatgaaacacaactgtgcaggctgatttctgcagctccttttatcttcagtaattcctacattgattgaagatttgtccagctgtttatacaatctttacccattgatgagtaatttttttttgttttataatgttaatcattttgcagtattattcaaaacttttgacaattgctcagtactgtgaggagaacaatgtatggtgacagtatcaggatttttttttttctttttttttggagtctcactctgtcaccaggctggagtgcggtggcaggatcttgactcaccacaagctccgactccctggttcaagagattctcctgcctcagcctcccaagtagctgggactacaggaatatgccaccaaacccagctaattttttgtatttttagtagagatggggatttcatcatgtttgccaagatggtctcgatctcctgacctcatgatccccccaccttggcctcccaaagtactgggattttttttttaataatagaggaaaaattcacgtggccagccattgagggcactatctgcatagaaccttacacaatttctctaagatgaagtgtttttttccatatatgaagacaaacaaatacatgatgacctttgcttagttgagacacctatgcacagcaaaacatattttcttggattttactgctatttacatttgttagcaagggctgttaaatgtcaacttgatggagaaactgcattttggtttattagagaaatctttctcagtgtcatgtgactcatcaatatgttgactaattgtttggcttaggagctaaacctttccagtttctcccactgcaccctgtcctagcattccccactatgcattcactataattttattgctacatcactaagtttgcaccaactgcttgactttgctttttgtggccaatagactctgctactaaataacttgcttcctgagccttttcacagaatgtgactatttttttaacaaaagcttatctgtatttgagattccagtagccctttaaaataatcagcaccattacttgtcaaatggctgtgattcgcagttaagtgtcctcaattttgccaaaggcagtgtctgtaagttgtccaccgctgatgatgcacctgaattgctcaacttgggttacggcagtggagagcccatgataagtagccttcatggtaaagacaggattcatttgtagtctacatcacattagagtggtgaaattataccgaacagtatgattctttatcactcacctcttcaaaattgtctgtagacctaggcctggaaaatttaccttctgttttgcacctgcttttcagaaatggccaccttggaccatcagacatcacaatggctgtttatgttttacagctgttttgtagaagaatatgttaagtattggaataaagctaccagtttatgtagtactatagagaattctagggataaaagcaactttgaaaatcatgaagaccatgtccttctttaaatcagaaaagttcatagacacatacatatatacacatatagacagacacatggaaacaatattctacctcctgctctttgctaagtgtagagtcctttactgtaatagattgcaagtaatgacggagaaagagagagacgatctgctttgatacctgtcctaggttttatactttgttaaggtcatggaaaagtttgtattcaggaaataccatatttgaaattaactttatactgtcctgataaatttccctgagagaaatttcataaaaggaacaaaaatgaaggatcaagttgacacatgagaaagaagagatctaagatatttaagatactttcagattaaacattaagttggtattaattcatagaaataaccatattgacattttacttactatagctgtaaggcatcttggactagcacgtgtcttgtcatctcctgcttgtcttcatatcttttctcattagagaaaagcaaacaacatttctaagatttggctccattccctgtctccacccagcatcctggtctccctgaaccccgtctagtcaagcttctgtggctcctgcccactgaatagctccaggcaagtctgcagtggtggccaagctgtcagattggacggtccgttcccagggcccccgcctttgttactggaaagggatcccaatccagaccctaagagagggttcttggatctcatgcaagaaacaattcagggcgagtccacagtgcaaaagcaaaggcaagtttattcagaacgtcaactgggaaagagcaagctactccatggacagagtaaggcgttcccgagagtaagagaaagaacgcctccatcccaggtaaaatgcttgttcgtatataggatgaaaaaagatcaggggagatgttctttgctacaagggtttgtgataaaggattaattttctgaattactatattttgcaagaatctatattattttctttaaagcaaaattaagaacgctcttttttcaaggtatcaggatgtcggggcacttttaattttgggtctgtttagtaaacgttatcaatctcttcccttaaccatgaacctctagaggctaggaatacataactttctagggatgcagcccagcacgtcccaggctcgttttaccaagccctcactcaagatggagtcgctctggttcaaacacctctcacaccttggcctgtggttagcactggacacttcacctgtggaagactgttttattacctacttagactctgcttcttgatccccttcctatctgactctttctgctttctcagttgctttgctttggccacttcctgtctcttcctgtaaacactggagttctcagggtcctccacatcctcattttcttcatctgtcctgactctgatcctgcagcttcaaatacaatccatctgctaacctctaccaaaatgttcctattcagactctgaactcagactgcaaacagtgaattgtccacatgacatctccactaagtgtccaacagacatctcaaacacagcatgtctaaaagcaaactctgggtctcctctacaaaacctgttcctctcacactcttttcttcttagaaaatggcaattctttttttttttcagttatttaggctgaaaattattatacttatatttaatccttcttttgttctcataccccacattcatcagcagacccatacactctgttcattttccatcatgttggggatccagccatcctcccatttccacagttaattgccagtctcggcaatcatcactgcttgcctagattattgcaaatctctcctaactcatttctgcccttctgcacttgcccctgttcattctgttctcaacacagaaacgagtgattattttcaaaagtcagtttatatctctagtttgctcaaaatccccagtgacttttcacctcactccctaaaaacataaattattctaataatgttctccgatgtcctctgtaaaacatgcctcacctctgctctacgtcacatcctgggcttctcccacctcccttgctgctaagacttaccagtttctcaaaagcatcaagcatgcctgggtctcagggtattgacttttgtccttctctctgtctgggatcatccttcaggatgcacagatttgctcacgatgcatgaagcaggttccctttgcactggttgtcaacttgtctgagcccagcgagacagaacacacccacaaacagcaggtgccatgaagtgggattttactcacagatgggcagcagggaggaagaggagccccatattcactgccagcgggtcccccaagtctcaggagagctgcctggggaggacggtgtctccaccgcatgagccccacttgcaccgtagctgagggacacgggaaagcagctctccctgggctttgtaccccagggttatggatcttgcttagctaaagcatcgaaggatatcctgtcctggggaaagactggaagagagtccaagctgttccattcagctccttcttacctcaacctacagcatccccagcacatttgacagttattcttgagacatttgagcaagaatagggggagaaacacatctgaactgtcctgtgttacctcctatgtatctccatacagcatagaattcaaggaggccaggcctgctcacagcacgtacgctctttcctgtctataaccctgttccgtgttccttcccagtccctgccagcatctgacacaggatgtagtcactgatttattgctttttccctgcctgagaaagaaagcaaggtcagagactgtcagtttcattccctaacgcacatccaatcgtagaacggtatctggaacagggtaggtgctaaaatatatttgtaaaataaaataactaattacctatcttcagaattgaagattctgaatgaaccatctgaatgattgaagattctgaatgaaccatctgaatgaatgaaccatcttcagatgacataaaagagtaaagaatttatgacagtatgtcacaaatagtcattgattaataagaggtaagtatcaatattaaggtcaagcaagactcttagttttgaagtattttgtaataatgtaactttaaagggatttccataggaaataaaagagtctctgttgaattttttaaagactatagagcacagtaaaataaataatacgggtgcacataggtggaagtagataattaacaacaaatattttttcctttttttcgaaatggagtccctgttgccgagactggagagcagtggctccatctaggctcactccaacctccacctcctgggtgtacaagccaccacgcccagctaatgtttgtattttgagtagagatggggttttgccattttggccaggctggtctcgaactcctaacatcaaagtgttggaattgcaggtgcaagccatcatgcccagcacaaattttttgttttttaaaaagaacagctgtagttgatattattttgtttatatatatttatataatattttataatttttaattgttgataaagaaaaatgaattttctgaactagtactaattatagggtgtccaaataaaatattttgattaatttgattagtgaagaacgtctacctgtaaaaatcatgacccatttttagagtattttatttttattttattttttattatatatatttaatttattctcatatttttttaatttttattttgagttccagaatagatgtgcaggaggtgcagatttgttatttcggtaaacatgaaccatggtggtttgttacacctatcaacccatcacctaggtattaagccccacacgtattagctattcatcctgatgctctccctccccagctcccctcaacaggccccagtgcatgttgttcctttccctgtgtccatgtgttctcattgttcagctcccacttataagtgagaacatgcagtatttggttttctgttcctgcattactttgagggtaatggcttccagtttcatccatgttcctgcaaagcacgtgatctcattccttcttatggctgcatagcattccatggtgtatatctaccacattttctttatccagtctgtcattgatggacatttgggttgattccatgtctttgctgttgtgaatagtgctgcagtgaacatacatgtgcatgtatctttataatagagtgatttatattcctttgggtatatacccagtaatgggattgctgggtcaaatggtatttctggttctagatctttgaggaatcaccacactgtcctccacaatggttgaactaagttacattcccaccaacagtgtaaaagagtttctgtttctccacagcctcgccggcatctgttgtttcttgactttttaataattgtgatctgactggcatgaaatgatctcattgtggttttgatttgcacttctttacttatcagtgatgttgagctttttttcatgtttgttgactgcatggatgtcttcttttgagaagtgtctgttcatgtcttttgctcactttttaatgggattgtttgttttttttcttgtaaatttgtttgagttccttgtagattctggatattagccctttgtcagatggatagattgcaaaaattttctcccattctgtaggttgtctgttcactcagatgatagtttcttttgtcgtgcagaagctctttactttaattagatcccatttgtcagtttttacttttgttgtaattgcttttgacatttttgtcatgaattcgttgcccgtgactatgtcctgaatagtattgccttgattttattctagggtttttatagttttgggttttacatttaagtcttgaatccaccttgagctgtacttgattttaaaggagattctgtatagggcactgttgtgatgcaagatttccaggtatttctaagaagagttatcacctattcaactctgtttgccaaatgaggaggttgttttgcaagtaagttgaatcaggaagtgctggttaaaattcattgtttaataagcctaaaacattggaataaggttttttttcaagactaaactgtcactgtgttacactcagttcagtttaatttccaagtattgaaactgtgaccgtaaacaagtctacaagcaactagaatcacagagaagcctatttatgagccaatcagagattgcagtgtggtgcacacagcagcagacacaacagaagcagccctgttttactggagatgcaaatataagcaggctttagaagactgtttctcaaactagctacaatttatgggaaacagagaagttatggtctatccatgaagcaattgtgtctaaattcaaagggaagccgttttctaagttcgtttggtcgaacaaaattatccaccagattttccacggcaccttaacacgtctagagttttctttccttttttgtaggcattttctttcttgtgtttttttttttttttatcataaagaaagggctagagattcttgttttcaatgtgtgatatgtttttaattttaaacactgttatcccacacttgatttggttcttagtgggtgacaaggtcacccaacagtgagggatgggggagggagccttgctgggatttagaggggcagagctgtgtttcgcttcaattcttggcgaagtgttacaacttctgaatcacgcttttccttgcacgtttaaaatgagaacctttgtgggcttcataatataatgcacatgtgtagctgtgttttaggctctggagatgcagattagaacacacataaacccaactgtcatcatgatgtataatctaatgggtgaaggcattagcctggaaacaaataatatgtatatacttcttatagtaaaggtgttgcccagaaggcaaaaccaggagtagagaaagagctgggattggcttgggggtgggaggtaggcagtagggggaagacaaccatttaatctaaatccgcccaggagagagtgactgaaggattaatgatacacatgaggcagccttgcgaacatccttccagacctaaattacagcaaatgcaagagccctgcggccagaacatcttggtatgtggaagggaaagacaagcggtccctgctatccgcgggtgcagggaaagggactggggcaagactgtaagagacgtggctcagtgatggaggagaggccatctctgggtgtttcaggctgtcctaatgtgtttggattttattttcacttcaatgagatgctgctgcaggatttctagaagggagatgctttgatgacattggggtctcacaaacgttgctctggcggctgtgtgcagcatggtgtgtaggtgaagcaagagtgggagcagagaacaactaggaacacttaggaagaccgcagcagcactccaggtgagaggagacattgccttccaccaggctcttggtgcaagtggagaagtgtggcttcccgagtaggatacatgtagagctgtgtgactgctgatgaatcgcaagtgcacgtgacggaaaaggggcaatcaaagatggcaggccatgccacgttgctaaggaagaaaaggccagtctggcaacaaaaagaggaaagctctatacctttgttgagtggtggggaatggggctcacttttgtgggcacacaatcacaggggaggcaactcaggttagccagctcaagtgcggcatcgcaggcgaggcatcgcaggtggggcatctcaggtgaggcatcgcaggtgaggcatctcaggtgtatcatcttaggtgaggcatctcaggtgcatcatctcaggtgaggcatctcaagtgcaccattttaggtgaggcatctcaggtgcaccagcccaggtgtggaatcccaggtgcatcatcccaggtgaagcatgtcagttgcataatctcagatgaggcatcgcacgtgtaccatctcaggtgaagcatatcaggtgcaccactgaaggtgaagcatctcaggtgaggcatctcaggtgtgccattgctactcagttccagctgatggtgctagtgggaatgaaatgcaaggtgtagttgatccgtcatgtaatttttcaagtaaagatgtaaatctagaagtccatgtgcaatcgtttggtttataaacttgaaacactcttttaaaaactctgtgcataggatcgggtcattgaccatcaggttctgcacatctagcataaaagggtttaccacagtcttgtaggaaagccctttctctaatgaggatatgataaatagaagaataaacgataccctgagtgaataaacaactttaataggagaaacactcattattctctatccaagagaagtaaaaggaacatcaacaatgaaatatgggagaagaggctcctgaattaatttagaagtatttattgtgtctgtaacatttgaccaagtttgtgccaagtgctatggatgagactctttaattggtgaagtgttcttgttttactgtcctaaataaaatagttaaaaacttttgattcttgataatgtatgaagtgatatatgatttttgcaaatacaaagtattgtaaatgaatatatgtaatttgcctgaaataaatgatgctacataaatttcattaaaggaaacacaatttccatcattacattatcagaataatagagctatctaaaacaaacatgcaaatattaatgtttaaaagaaggattcttttagggggtttgtccaaacatttatgaaccaatgtcttaaattcctgaggaaatcactttacatattttattatgttacaattagctaacatatcaatttttggaatgcaacaggtgtagtatttgtgtctgttgcatgataacttatgatgtataaaaaaagtacactaaacaacaataaaaactcatacaggtgataggaatatgagtcatataagcaagagtttgcgggccgggcatgatggctcatgcctgtaatcccagcactttgggaggccaaggcaggtggatcacaaggtcaggagatcgagactgactatcttggccaacatggtgaaacctgtctcttaaaatacaacaaattagctgggcgtggtggcgggcacctgtagtcccagctacttgggaggctgaggcaggggaattgctggaacccaggaggcggaggtggcagtgagctgagatagtgccactgcactccagcccggcaacagagaaagactccatctcaaaaaaaagaaaagaaagaaaagaaaaaaagagtttgacctattgttgcacaatgttgcatgtgaaagctcccagtaaatactgactctactgacgactagggcaatcgtacaataaatccttctaaactagatttaattttctctacctgggattcttatctgagccacagaacacggaccgtgggaccgaacacccaaggatggcacaaacctaacagcattcccggtgctgaagagatgacttagtcccttccacacaatggacacttttgggtattggggctcctgccacctgcaagaccggaggagggaggctgctctgagggcacagatcctattgctctgtgcctacacttctgaccactgccactagatggtagtgacagctcacacttctgaattaccgtttctgttcacactattcatgatggagacagtgactaccaagtactgaatttctaccaggaaccaggctcatccttctcatggaggccaatcctcgaagataccctggagaggaaaaaacataatccccattaatcaaagaggaaacctggcccaacttcactcagcccattggtgaacctgctttctgactctaagcccattcttcctctacagttgcacgtagtagaatcaatggtcatggaattctgacaccctcacttaagtgttaacattaattgaagccacaggctgccattttaaatatgttgtaaaataattagtttaagtacaagttgctgtcatacacacaaacttattaactcagctcatttataaattaatattgatgcttcgagtcttgaaaagcaaacctacagtgctctggatacgtctgctgaaagccccgtgctctcctatgtaatgacagttgatgatccggatatcacagcttggtatcataaaaacaatgataatatttatcagctacttggggacatctctacttgtgtatggccaggacctgtgactatgacagcgtggtcgctggcttgaggaggtcactttttgtttcaagttgctgggagagtccctccctggatggccctctgtcatataactgtaaccgactggtgggggcttctcctgctagccttgaagcagcatccaccaggagggggaagcttagtggccagcctagagttctacctacaacagggccaaataccacacttcatatacaaaaactggtgggagaggaaactgcaaggaatccagcccttgggaattttcaaagcatgtgggaaggtgtgaactgccaagcactacataattgaaggttaaaatcaagtttacttggattaacaaaaaagcaatgaggggtacaagtgcaattttgttacatgcatagattttgtagtggttaagacagagcttttagggtatctgttacttgaataaggtacattatacccattaagttatttctcattaagtaatttctcatccttcttcttcctacccaccagcccccttccaagtctccgtggtcttacaggtcacactctatgtccatgtgcatacatatttagctcccacttataagtgagaacatggaggcttttgcagcaatgtggatggaaccggagggaagaccccttgaggtcaggctgcaggtgtcagggttcacacttttatttccatttctgtcctctggactcaggttcttcctatagtgactcagcatggtatatagaaagatagaaagtacggccaaaagcttgaataactatttcagtgtcgtctgtcattagcttcccacagtggctgggtgcggtggctcatgcctgtaatcctagagcttgggaggctgaaacagaaggatcatttcaggccaggagtttgagaccagcatgggcaccatggtgagaccctgtctctatataaattaaaaaaaaaaaatattagctgactatgttggtacaccctgtagtcccaactactcagtaggctgaggcaggagactggcttaagcccaggagttgaatgctacggtgagttctgattgcaccactgcactccagcctgggcgacaaagccagatgctgtcaataaataaataaataagtaaatacatgtcttacagtaaccctggctatcttttacttgaattctggactaaaccatttgtaccaagtagctcccagatggttgatgaatacatctaggcaaaagagcaacgtttcccaaaatgtgacccaaagaaaatgttgtgtgagaaatttgtaacaaggaaataaagtaatcttagctttaagatgccatatgctcaacctggatgcttatgcagttgttgcttaaaggctctgggactagaagaatgaaaaaggatgtacacaatggttttctaaaattgtttggctatggaaatggcattcccaagataccaactgacatctagcagaaaagcccttaggaaacacaacttttagatcagtcactgaaagtaaatgattgtacactaatttttgaaaagtttttctttttttttttttttttgtaattgagaaagccaaaaatatctacttatcgctgagcatgagagagggtgtcataagtgtgatcctcacatgctgataggcactttgcccaaaacaaaggagagaagatcaagaggcattaaactgagtctacaaagcaatcctgaacacggcatttaaagagaactgagaggagtgtggaaaacaggtctccaaggagcttacatcaaggtaaagatgaaggaaattaataaattttcaaaagaaagattaataagtgagttagataattgaatgcagatcttctggactacctaggcaaagggcgtggcattgcaggagtgagtaagtgatgaaacaccaagagatggaattacttcaagggtatttgttatttcacagtgcatatgagtgagagcggggaatatgggctctcatagcctcagatactaaaacaatcatttcaaaggaagtcaaaactagtaacttcaagcaatgacttttattcatagaatattcttcttccgcaaaagtagatttaaaatataaatattgccaaaacaaaattttgtttcatgtgccctcttatccttagagagttcatgtgattggtggaccaaagggattcttggtgaatgacgagctgatacatctgaaagatttcgattgtagatacctacagactaagatctctaactgtacagctacttgggagaaaaaaagtgaactttcatgttttccaggttttgtgatagttacaagagtaaggaaagtaaaagagatgcctcaagcaccttggagcttagtactgagttccaggatgatacatcacggtggaggcacgtgtggtgaaataagtgttagtggagtgaagctcatgggcctcccagagcctctgggagattccagatgcagatgagtggattcagggaagcaagggcttccctgagattctcattcaacagcagtgtgtgaacctgctttatagacatagtagtgagagatgtctttgaatcacatgatgctaagtgaagtaagctgctcacaggacaaatacttcatgattccacttacatgaggaatctaaaggagttaaactcatagacgctgacagagtcaaaccactgttatcagggagggggaaatgaggagtcactgttcaaggagtataaagttctcttatgtaagatgaataagttctagagatctgctgtacaatctcggtttatagttaattatattatattgggcatttaaacatttgtaagaggtagatgtcatgtaatctatccttatcaataaaaataatgaaatacagaaaataggcatctggttttagggtgctctttctttgtgtacaatttttggcacagaatttgatctttaaatttcttcctctgcaaaaataagtcctttcatgcttttccttcatgccaagatggtgatggaaaggtacattggatgaattacgagctgtttatctcaaagtattttagacatctttgcccttaaaacacattattcacttaatttgttatgagtagaagggaatgtataaaatgaggtgattgtatgagactctacatgataatactttgaaagtatatgtgctatgtcatggtttatatttagtaatgatttactattgattaaaaaatagatctcagtgtgaaattatattttctgtaggtcattgtgctgtgtgctttaatgacttcaaatgtgaatcagatatagattatatgtcaagaagtttacagtcttcaccattattatgttgtctatatattgatcaatagatatgacatactgaaagtgttattttaagcaaattgtttggaataaggatgagaatattattttttataattataattgcagatcagtttcagagtaatagaatgtaaaattttggcgtagtaaatctacaataacaccaaacggcatgaatgcaatcactcatcaaatcctgtgttgaacctacgtccatttctcaaataaggtgatctaaagtcctgatcatctgaggggaaggttgggatatggaggagaggtaaaaaccaggcaaggaaatgtcagacacagctgttttaggaaggaggaggagagttgccacaagtccatctttcttctagctcaccatcctcaccactcgctcatacacacacagattggtgtgaaaatgtgtgccaatagccaggagattcttaaaaccctggctgatgtcccagaagagccagccagtgacaccatgcagaatcatgtgaagtggcctcattgtctggcttgacacctagagttcttggtctcacacccaaggaaatcaaggacacggacatactaagggtgaggtttagagcagaaatttcataggagaaacaaagcgaacacctttctactccagagaggagtcccagaaaaaaaatgttgccatctcaaagtggaatgtaggggctttcatagacgagctaatcatgaggcagtatctgatctagacagggcatgaaaaactgtttaggaccaggtgtgccatctgcatagggcatgaatctgtgggatcccccattccagtcttttattttgcaggtgggtcctcagcctaagctactgcatgttgctcatttctttcttactgtgcatgtgctgattaggggagaggtggggccccatggtggaccggcctggccccacgtagccgtttctctctgtgcaactgctggcatccccctgtgtaagcttctagcttgcttatctatgtttgcagcccgatcttccaggctgctctttgttagaaaagaagtgatttcttggggtttttttgtgttacaagggaagttctgctgaggactctttgccctcattatctgcataaatagtttttgttctacttcctgtattgcacctatgctaacacataacctggagtggaccagcctcccacggggccagaccacagatggaacctggactgcatggcagggctcccagaacttctggctgcctccctctcactgccttcttctttatgctaccctggggcatttcaataatctcacaatgacaggatcaccttttatatttgattttttgaggggtgatgtttatcacatatagaataatgttactattgtgttttataattccagattctataatgaaaacacatctgagcaaatgccgcataagtcggataggggctaaaaaagattttagttaaaggttttgattactagtactcacacaacaacaaataataataattaatatccatggtgaataaaagccagaggaaatgggagggacctgaaaagttattttaggttgttttaaattaggtgaatctccagaaattatgcttattttcttaaagtagtatgggccaggtgtggtggctcacacctgtaatcccagcactttgggaggcctaggtgggcaggtcacctgaggtcaggagtttgagatcagcctggccaacatggcaaaaccccttctctactacaaatacaaaaaaaaaaaaattagctgggcatggtggtgtgtgcctgcagtcccagctactcaggaagctgaggcaggagaatcgcttgaacctgggaggtggaggttgcagtgagatcgtaccactgcattccagtctggatgacagaatgagactccatcttaaaaaaaaaaataggaaaaaggagaggcgtcaagattcactgcagcagggcaggcatggtggctcatgcctgtaatagtagcactttgggaggccaaggcaggagaatcacctgaggtcaggaatttgagaccagcctggccaacatggtgaaactgtctctactaaaaatacaaaaattagctggctgtggtggcgggtgcctgtaatacttgtaatcctagctacttgagaagctgaggcaggagaatcacttgaacccagaaggcagaggttgctgtgagcctagctcacacccctgcattccagcttggggaacagagcaagactccacctcaaaacaaaaacaaaacaaaacgaaaagattcactgtacattttgcttttattagtttaatagcagaaggaaagctaggaaatttacaaatatgtggaagttaaacaacacacctaaacaatcattagatcgaagaaaaaatcacaagggaaattggaaacttccttgagacaaatgaaaatgaaattacaacataccaaaacttacaggatgcagccaaaacagggccaagagggacatttgtagctgtaaaccatcacattaaaatataagatattgaatcaacaacctaatatattttaaagagctataaaaaaagagcaaactaaatctgaagcttgcagaaagaaggaattaataaagattggaggagagatgaatagagaaaacaacagagaaaatgaacttaaaccaagttgctttttgaaaagatcaataaaattgaaacctttagtgtcatggattatgaaaatggtcatagactgagcatttagcatgtatactcacggctcattcttctatcactgataaaattaaattgtcatggggaaacaaaaatgacatatggcacatcatttcgtgggcaaatttattgtgtatatatttacaaatgttgattctatgactagaaaggcctcggctttccataagcagcttgccctgcttctctcttgctataattaatttattgtccaagaaaatgtaggcttacagatcactgagagtgggaaaattccaggagggattgctcagaagaggaaacgaagtatgttgatgcattttgcatggctaaattccgtttcctgtgagtaaaacaacagatatatctcccaagatgtatttgtacatatgagttgcttagtaagctcttctgagaagctgatactcttcctcaaagcaaacactatacttttgacaaatcacgaactaggcgtcagaagatgtgcatcgcattcctgtgattctactcttccattgtgtggtcttggaaaaggtagttaaataatctggcattaaaatttctcctctatatgattagagccagagtcacataatcccaatttcttcctttaacccaaatttatgattctgtcttacaaaaattcctgctgaattcctcatgtatcaaccccccatctccttcaatatagtcaattattttaagagggagttactctttcttgaattgatttagtacacttaagtgtgttggccatgtgcaacttcaaagctgcttattttgcattcttcaaattaatgcaaaaaaatcatggaaaagaacttgcattgaaatatgagctactggcattttgcattttaataacacaactcttgactttggtagtctgattcaaacagtaggacctaaatcagtagcgtatgtattgtctttactacacaattggatattttaatgaaataatgattagttcacttttcaaagaagtcggtatattctgttgaaagtgtctgtgttacagcttgtactaaagtgagccttgttcgaaagctctgttgagattgataatattttgggcttctgaaaatatgtcagtataaatgtatatcaactgtcatacttttcactggcatgtaattatctaaggattatattatttatcatatttttgcagataaatgcaaatgaaatgcacagttataatacatacagagtattaaaactcatttagttggcattcttatgtttaaatggagaactatttccagtaataattttatccaggtgttttctgtctgtcaaccttcagttttgcaggaaattaatagtctcagcaattggaacattcactattccaatccctcaagcttttccatatgcactgacatttttgtgtgaggtgcagccaccatgtcccagaaatcaagaagaatttcaagacatttaattagtcagttaatataaatttgtattttgaaattcaaattgtgtgttgtatacagtttactgaaccaaaacactttgtttgattaattttatggaaatgagatgtgattatcaggaagaagagcccacagggttcctaaggaaatgtcttcttcctcaaggtttggaagctgaagcaaggcatagaagcaggcatggctagacttgcatacagagccatcctccttcccccacgagtgctaagacaagtgctcttagatatttgtattctcttgtgcctgtcacctttcctttggtataaatagagaggggaagaattttggcactgagctattagcaaaacacctcagtggcatacaagaacctggtgatttgagatgtgtctatccctttccacaacacataattcaaaatgcagtacttaatatttgtgcaacaaaatcaaactttgattctaccaggggagttaaccatgcaaaataattctatgtcagctccctttgtaaaataaagaatcactttccagtattcctcatttccccctgtatcagtggttcttatatgggggtggtttggattttgccacccaggggacaaatggcaatggctggagacagttttggttgtcagaaacccagggagaagtacgactggcgtgtggtgggcggaggccacagaatctgccagataaactgacctgcacagaactgccctacaaccaagacttagccagcctgtaatgtccgtggtgctgaggctgagaaacctgtttctaaatgtatctctctgttaagagatgcacatctactgttattaaacaggatgttttgtaactttattttgaaatacttacagatccaaagggttgaataaaacagtacagagaagtcctgtcttcgtttcacccacccctcccaccagtggtaagggtcacattgctctaagccaaaagcagagccagcaaattggcaaggggatgagctgcagacctggtttgagatttcaccagattcatggactcttagatgcccgtgtgtgtgtgtgtgtatagagttctgtgcgattttatcacaggtatcaattcttgtgaccatggccacaatcgagataccacccagctccctcaccaggcagacctcccctgggaaaccttttcatagtgacatcccaccctcgcccacacagactgtaatctttagcaacctctaatctagttcccatccctataattttgtcatttcaagaatgttatacaaacgaaatcatacactatgtaaccttttagaatggctttttgaaagggcacgagtgcctttaaaaataagaaatgaatatgatgtcagattagctgatttctcccattataattccctatcagcgccctgtaccaattaggagccaattaacatttggttctgagtagtggaaaataaaaataatagtgttttatattaaaattttatttttttgtgttataaaaacgtggagagagacatccgagggctcatatgttgtcttcttctgggttctgggctccttctggcattttctgggctttctttgcagcgtggcactgacccggcatgcatacgacaactgcagcccagccacattctgagtagggagaggcaaccagaaaaggatatagccccaccctccagagggctgcacccaacaacatagactcattgacaaagatcttatcccctggacaccattagatgaaaggaatattaggaatgtgaattactagcactttacctctccaaagaaaatgatgattgggtaaataagaaagcaaaggagaatacaggttgttacatacataaccagcgtcgtctgctgcaaatactaggaagtgtgttttacaggaagggaaactgaatgagggtaagtaacttattgaaggggatacagctaggaagtgacaattttggctttgaagccagatcttttattttgcatccgggcaaatagtgtaaaatatcgatcgggaaggtaccttggaaaaattatttactaatacttgtaggatcacacattgccctagaataaacacaggcaatgatgcattagtgacactctggggccgttcccattcctgggagcttgcttttgagtgttttatgtaggatgcttggtccagagagcaaattctacagaatagccagcttctggtaatatatctgctgtgtctaaactgcatactaactttaggccacttaaaaatttaaatatatttaggattgaagaagacgttattactctcaactcacaccaaagggatttggagtgtccaatttccacaaaaaaaaaatatattttaaacattgcctatatctatttgcttttcttttcttttggtagctttatattttaagacaatttatattctatagaaggttcaggaaggaaaaacgatgtagtcttatgattgatgagaaaatgtcagaaatatgatatatgccacatttctgaattaattgaaacttgccactttcaatttctaaacagaatgtagactgtttttaaagctgaattgacaattcagcatgttgatggttctttgaagctacatatacccaggctattaattgtttaatttgggtaaattatttaagctccatcccatgtttgcttgtcctagagaggtgctgattttaccagagctgaagaattgttgtaaggcttaagaacaatgcatgtaatacgatttgtgtgtggtaggtgcccagttggctgtcttatacagatcaagttaataacattttctaatgggggttctggagacctggggggctattgattttttccgtgtgtcaacttagtggtaagcaaccaagtttctattagaaattcttacaacgtgatgttcccattcatttcctttgaaagtacattgcgacaactaggtgttaaaatctgagtggttcataggaagctgggtacatagagcagcatttaattccattgattgctatcatgatgagattgatagaatgtcaggcaagaggttttgaagatacgatgccctcctagtgacagacttatccctctgcttgttccctgaactgtcaagagaggcaatcgctttcaccaatattttcagagtaaaatcagtgtcagggtactgcgtttcttatcacggaggatagctcttcatgtcctgctgtcagttataaaatggcttggcttgtaaatttttgtgaactcagtacctgggatattactatgattaccttgaaattaaatccaccttagaattttgatccttatcctgcctcccagagtgcttttgaaatgctgcccttctcactggaaatgctaattcctttttaacctggtctgttgctttgaaagttcctgagtgcttttaaggaccctcagttccagggatgctatctcccctaaggaaggtcaaatcctgaatgatttctgacggctgagtctcacacagaacacagacaagaagaccctactgagactcaagactcactgtatgtggcttgagccttctatgtgtgtaactttgagcttgaaaaataagagattcactttagttggcttttcagatagagtttattcggcgttggaccaagggattggggcagaaaataaatgccaacttgatgatacatacattatcatttttcctggggtgcctaatgagtgtacagtgtgctttttagaaacattttttttttacatttcatgataccaagtttattactatttttaactccaccaaaaatttgttcttaaatacagtgatgttaaaatagaaaggaagttgtaaaggctctgtgtgtgcatgtgtgtctgtgcatgtgtgtacttctgtgtgcatgtctctcggtgcacttgcatatgtgcatgtgtgtgtgcacatgtctcggtgtgcatgtgtgtgtgtgcatgtatgtgcttgtgtgtgcacgtctctttggtgcatgtgtgtacatgtgtttttgcatgggtctgtgtgtgtgcacatgtctctctgggtgtgcatgtgtgtatgtgcatgtgtgtggatgtgtgtccttgtgtgtgcataagtgtctgggtatgcatgtgtgtgtgcatgtgtgtgcttgtgtgtgcgtatgtctttgcatgtgtgcatctgtgcatgtgtgtacttgtgtgtgcacatgtctttctgggtgtgcatgcatatgtgcatgtgtgcgtgcagatgcagatgtgtctggttgtgtgtgcatatgtctgggtgtgcatgtgtgtgtatgtgcatgtgtgcacttgtgtgcgcctgtctttctgggtgtgcatgtgtgtgtgcatgtttatgtgtgcatatgtctctgagtgtacgtgtgtgtgcatgtatatgtgcgtgtgtgtgtgcttgtgtgtatgtctctgggtgtgtatgtgtgtatgtgtgtgcatattgtctgggttgcatgtgtgtgcatatgtgagtatgtgcatgtgtgtgcacgtctctggctgtgcatgcatatgtgcgtgtgtgtgtatgtatgtgcacatatgtccatatgtctctctgggtgtgcatgcgtgtgtgcatgtgtaagtgtgtgcatgtgtgtgcacgtgtctctgggtgtgcatgtgtgtgtgtgtgcacgtgcacatgtgtgcatatgtgtctctgggtgtgcatgtgtgtgtgcatgtgtaagtgtgcatgtgtatgcacgtgtctgagtgtgcatgcatatgtgtgtgtgcgtgtacatgtgtgcatatgtctctgtgcatgtgtgtgcatgtgtaagtgtgtgcatgcgcatgcacatgtgtctctgggtgtgcatgcatatgtgcgtgtgtgtatgtgcacatgtgtgcatatgtctctgggtgtgcatgtgtgtgcatgtgtgtgtgcatgtgtatgcatgtgtctctgagtgtgcatgcatatgtgtgtgcatgcacatgtgtgcatatgtctctctgggtgtacgtgtgtgtgcatgtgtaactgtgcctgtgtgtgcacgtgtctcggtgtgcatgcatgtgtgtgtgtacatgcacatgtgtgcatatgtctgtgtgtacatgtgtgtgtgcatctgtgtgcacatgtgtctgggtgtgcgtgtgtgtgtgcatattttcacgtcagatcacctttctgctgccagccatccacaggtgggcgaattggactttaggcaccttattctctctagggctcagtttctgcatctaggttgcaaacgctttgatctctcattgagagctttctttgtccctcaaagttccatctcacgtaatctcagaatgacactgtgttgccacaatagaacaaaataatttagtaaagcaaaaataattacagaaataggttattcttatgtaggctttattttaaatcctatatggtagatgctttaggtcttactatgatccatagcatgcgggataattatggacacagttgtatttgattccaagtagcccagcatctactttgaggaatgccaaggaggacaattttctacgtgtttaggaaaaatgtgcagatgtaactataatattggatgtggagttagagacctgaattcaatttttaactcttatttttaagagtagtgtgtgtgtgtgtgtgtgtgtgtgggtgtgtgtatatatgtatctccattttgtatgtatataaaatagataaatgagtagacaggtttaaatatttgtcaatatataaatatattgatattttatacatgataatatataaatatattgaaaggtaatatttaatataatttacattaaatatataattatatatatctaacaaattatatgtcaaataaaatacgtaatttaatatgtaaccatgaaaaatgtgttgggttccctgggcattgtggtagagcactttgtagttcccgaatgccacatattaaggtgcagaatcagtatcggtgtgaatgtaccgggacgactgatctactcctcactgaaactcacatgtcacaaagtctgcaataaagtactgccatgtgatcatctacccttcttggagtgtgggctgcctgaaacatgagtagtgttcccatttctttctctattctcagtcataaagtacttataactcagggggctaccaatgttccagtaaacaaaactcacaaaatattttgtaaattgttatgccatctaaaagtaaatgcagctgtctctttgcctggagaaatcgaagctgctggtagatacaaaacccccacacgaaatggaaacaatatatatttttatacttgttcctgacatacattcctttaaatgttaagtcaaaagatatcctttacaatttcctctcctcttttttcttacttcgtagttgccaataaaaagctgttgcttaatggaaattattgttttcaaagtaatatcatatgcaatattttatgtaagataaaataataaaaaatttaatcatataacgatttttcacattgctgaacacttcgaataatttgactttgcagtcagagtggtagtttaaagaatacagaattgagggttaaaaaaagttaatgcaatttagataaacatcccaaatatctataaggagaaaaattattcacacaggcaatactctaatgtaattgagatgaaagataatgcaaatacttgtttacactgtgtggaaatgaaagttttgttaattgcatttttgtactttccaatatgtgatgaatatggatttaattgggtttgcctcagcttttattgacaacacaaaatttggcatcaaactgttccgcggtattagaatagatagtatgataatatacatttcttaaagctaagaaggtgtgtatacagagaatccattctttgtcattcaatgcattttgttctgggaatacaataaatgagaatttacttaacatctttgaggcatactgttctcattaagaaaattctggtcatggttgatgacctttaacatcacttccagttataacatttactgtttaatcctcctgtaaatgtactttgctccgtgtacaagggatttagctaaacaccaagaaggagcaatgatggtcagtaatagatccaacttgggagtaacttatgtttactgatgagataagatactcaggcagatcattgtaatacagggaccggcatgaccacagcaaggaacaatgctatgggccatgaagttcaaggccagtgagcttcctagcttgctcaaggaggacttcatggaaatggtggcactgaattgttgctgggaagacaacagggctgacatcatgggagaagggccaacagcaaagaaacagaggtgaaaagacatgtgaatttgagagagagtaagtcattaacttggctctgagcacagggaggaagcagattggacgaatccctggggaaatcagcaacagtgagaaaccagggaaggtgtttaagcaagggtggtgggtgtgaaaaaaatagagttaacctgttttaataaatacattcattttcagtgtgtaggatggactggaatggtgactggtagaaagtgggaagacttttaggagataatgacagtaaaattagaggttgtgtgtgactggaggcataaagttctaggggtgacaggtgaagaacatgaggaatggatgctccagagagggctttgactttgatgggcacatggttttccacggagcacaaaggggagcaaaggaggaaccaacaatcatcccaaatgttgaagctcagtgaccaggaggttccagtgctagacacaagggtgacaaagcctaagtggggttcaggctgggagaggttgtatttgaggtgttgatgtttcctagtggagatttcctctacagatgtggtgatggggtttggagactggctggtgataagcaagtgtcattgtaggatatacacacaaaaaaaggtgggcagccatgcaacaagcagaaggtagaaaaacagacttaaagaaacaaataaacaaacaaaagaggacccggagatgcaggtgaaccaggaaacagccagtgaatgagcaagcagtaaatggtgttgtctgtgagttttaaaggttaaatgtacgcacttctagaaatgatgggatttgacaaccaagctaaaacatgatataaaattgacaagataataaacattttattttgttgactacagtctagcaatagtaacttgatattttaagattgttttatttttaagatatgcttttttagctgtatgtgatgatatactttttatggttgaagtgtttatttttgaggatcataattattagtcaaaatattcttctgcagtttatgtcactgatatcaaagccagttcttcaacattttggaatagaggaggttgaaacttcaagtttggtatggtgcttcctctctggccaacctataatcaacttatctacatatagttatgaagtacttttaaaaattataatttaagtgaaattctcttcttctcggttctggtttcttaacagtaattctcatataaattatttctctgtgcctgtaagtatgtttaagaagcataaatgatagaattttactattattactgtggagcaagtttcacaactatacgtgtatatatatatatatatataggtatatacacacacacacatatatatgcacacagataaagaagttttaaaaaagtgtgcctgactttcagcgaaattatattagcgttgagtttataaaagtaaactactgtagaaaaccactataaatgtattaattgagtaaaataattgctattttagtgggaggttgatgggatggttgataccatggtaagaagaggtaacagtaatgtagcagttaatttattattaaatgatgcaagtgttccatacagccaactttctatctttacacatatcacagaaaacacaaccccattgtatagcgtgcaccactttattcattaaattaatgaagcagccatggcctgcatgctgcttgataagctttcgtatgcatgtgctacagatagctgagtggcacattgcctcatccctttctgatttgaaggtagtctctaccaaggtactcattggtcctcatggcggggaaggtcaaaatgagctttctgacactgtgctgtatactagacaagctggctggagtttgaatgtagtctcaattgtgagcctgtgtttcctctcagatgatcaagaaacttcatcttttacatgaaccagcatgcaattaccagactagtgaattgatatgcataatccatagaaaccctttcaagattgacttctttttctgcagataaatttttatttggggttggagctaacagtagaagctgtttttgaatttgaagactcaggtattttcagaaagaaaaatatgaacaggacaaaatgtttatatgcagggaaagaaaaagtgttggtaattttgcccttcagtgataattaatcacgtgttcaggattaaggaatttttagcttattaaataggtatgtttttctttttaagttgtgcagtacccaaatatttgcacaggggacagtgaggcacaaaagtcaaattccttaactctggttttaagaggatttttaaaatgttgcgatagaaacagaagttagcttgcaaattgtttaaaaacagatcatttatatttcagtttaaaagtgctacataacattgttgtgttgaaaccaaataaaagggacaatatgaggagattcaacagctctcaggataagtgtcttacggactcactgtaaataggactgtcttgttatagtatgactggcgatgtgaataatatttattagtttgatttatagaaagtttgcatggtgtctagttccatctagtaattaattctaacaaacagagcatgtaatgaactgttcttctccacattcctcaaggactttgaaaaccacaccaactacttacttaaattattctttggggcatgattagttgtttctcatttgttttatttgtttcttcctttcatttttgataccctacattaactcccaattctgagttattttgaaaagctgtattgttgcattctaatttactttcacatagatactgcattttactttatggcaatcattgatcattttagtcatttttctgattctttgttgagtctaccaatgagattttacaaaagcaatattgtttctatgtgtcagaattttaaaagcagatttttgtgtgtctccgtctatttctaaatacaatggcatctggaatatttacaattaaatggttgtttcttatatgatgttggtacgcaggtttgcatttaagctccagaggaatttgcgtcagcttttggctgcatgaaataattctctcttatataattttctcttatttgaagaaacatatttatgaaggaaaattaaaactacaaaaagattaaaaaataagtaatcattggtccatagttcgctaataaccatacaacattttggtatatttccattcttttttttctagaaatagttaatattgttttgtagttataatctatagtcatattgttttatagttataatcacattttctaaacacttgaatctgatgataaatcttcttgagggagataattttctagagttgtttcttaagttcacctacatgatttatatgattatttattgatgaggtttaataattcatgaagatttgacttgttgaagctattaactgtggaaggaggccccgaactcttcacatttctttaaatctcctttaagaatggggttgtaagcctgcagttgaggatttctaggatgggtcgttgggtgtttcttctcatagactaaaagggaattctgctcgttattttttgttacaaatttcccagccttgaattcttcattttaattaatctctcagccctatgagttatactatcaaaaaatgtgactgaattcgtttgtgtctacaagtgaaaaattgtgttagctagaccaaaattctttcagaaagcctttttccccaaaaaaatcgtatagtaaatattattccctcagcctgtatttggtattgcagaggacagcagtgtggaatgagacttctcctcccattctcccagggacttgtgtgacattggaacctgacattttctaagtattttttatcaaactatctttacctgcaaatttcactggcaatttggaaatcaatgcataggttggagtgtagaggactctctttgcttggatactaaggattgtttatcagcttccttaaaacacttaataacaccactatagttttgcttgtttccttaaattttacttggattgcctgttctctgccagccctcttctttccatcttttgttctcttgtgattcacaactctgtgtcttttcaagttttccctctaatcacagattttattaattctactggcaattctgagatgcaaagagagtcaaacatctggtgacaggcatgagaagggatgagcatgaggagcacactgcaggagggagctagccacaccatggcctccttcctctcctgagaaggccgccagatgccccttccctggagctgtcggttccagtgtccccttgatctgacaccacaccagctcctttgctcaccatgacacctaaccagtgccctgttttctgtgttttcaccctcattcttacagaagcatcctctttatccactcgttgattgacgggcatttgggttggttctacgattttgcagttgtgaattgtgctgctataaacatgtgtgtgcaagtatctttatcaaataatgagttcctttcctctgggtagatactcagcgatgggattgttgggccaaatggtagttctacttttagttatgtaactacagataaggtgcagtgtatactgctgtggtgaggcatgccccaaaatatcacaaatctccaccaaagaactttctcatgtaaccaaataccacctgtaccccaatacattatagaaaaacacaataattaaaattaaaaacaataacaacaaaaataaacatcctcttaaactttgagtaaatttctgtggccactgaaagattttcaagcagacatgacctgataatgtgatgtgcttctcacaaaggtgtaatgagaggagtagcatagatactacagcctcttcacagacactgaagtggcaactccaatgactcactcaaccaggcctggctagacgattttgaaaactagtctgcattccagggcttttgacacatcccagtatttttctattatactaagctgtcttgcaacttggaagaagtctattcatctgctatgttgaccttctttggattctttataatcccagaacttagcatttactggagctccatacctatgcacagctggtgagtcttaggttttgcaagtgctgcagaatgtccctttccaggacagttatattcaaatttggagacaatattagtggataaggatattgtctttgaaatcaaaatgcatagatttacattctgttcctcctctttctgtgagaccacactcaagtaaccaggctgtctgagctccagtttcccagttctacagtagggagttctaataggatcatctccacagagatgttgagttaattgagtagacttactaattttaaacctttagaacattgactggcaacgaacagtttggtacgtcactcaaacacatactagtattcattattttagccttctgctgtaaccaaacactatttcaagatatgctatgagaagttaattttccccacgctgaagtccagttttctttccgtatgtataataggcaattccattgcccagtgtcatgactgacacttcctacatgttcagaaagtagttgttaaatgaagtcaatggggaaggcatacacctgaattaatgaatgctgaataacattcttcattttggcctagaatatgtgatgattgacttgttccaagttggtctgttgcaagttggccacatttccagtggcctgccaagtacacgtgccacagtaataagttttctgttggaaacattctaaacttccgaaaacggcaatgggagagcatgtcctgctttctcattctcctgaacagttgccaaccatttttttatttttccagtggtacttgtgaacaaacaaggaaataattgtgtgtattcctctcttgcaaatctctagttagcaaatttgtcaccaagtgtctaaacttcaccaacattttcaagatcataaagagccttagtttttgttgatcttgcacagtggtgatctgtagctgtgtgagtgcacggaacagcatgccagcatcagctcagatatcattatttacaccacatactccagaaaaagcaggtacagtgctgttatttatattaaggacaaataggatgtcaaatgtacttgacatttaatttcctcaaatctttaaaatttcatagagagtaggactttcatgactacttcttgatccttcgcatgtattcaagatgaattataacattaatgactgattttttaaatgtgtaaaatgttcattaactgtattattattttgaaaagttagatgtcgaatatagtcgatggattataaatttgattaaatgttaggctttaatttcagtataaaatgttgtttttaaaaggcactttgatatattccaataatatttatcaattcaaatacatttgcttgggcagcctttagcatatagatataaacaataataaaatttattttatttctctgattttttaaaaagtcattagatattatcagcaatatgttgtttgtgttaataatataggtacccactgtaagttacagtttaatcactaaaggatcatgtgcagtataaattatgaaggcaattatttttactgaaaaaatagtattaatatcatggttcagcttcaaatgatattaacaaaagatacctacaaatatgataaaaaaaatttgaaatgtagcctgggttatatatgactagcactgaaaaaagtagtgagtcacattaaaacaaatacacttaaatatagaatttaggaatattcccccaactataacatattatttatttgtgaaacattacttttaagtgattgtcattaaagccatttttagtcaattccaaaaattgaagcctgggttcttcagtggggatgacccgtgagcagatggggataacaccacatttgcaagacattatgtaatcattccaagagattgcatgttgtattgctaggtgtgcagtacctgaagacttacaacatcaccagggagatcagccacctagccaaaaatatctactagctgcaatgcactgaggacgtctctatgttgcaccatttataatggcttcctgagaaaatgaaagagactctaagaaagccggtcttatttagtatcctttacacaagagcatgtcttcatgagggattggggaacaagctatgacagcttcctgggagacagaagtgattacggagagattgatttgagcctcctatctgccaagagaagaggattgagtgatgctttgaaaaactaaagaacacagggtgttcctaagagaactgtgtgctattataagaaaattatttttctgtacgataaaaagaaggcctggattggaatctgctaccttctctgttttcttattacaagtacctactctcacttctaatggccccttcttatgttctggcctgaattattctgtggttataacctttgtgtgtttatctactttttcatactccaggatcttctctccaaatctgcaatgcagttttcttattctgtactctattacgtaattaaaatgctgtctatctctcatgtgtttggtgaagctgcactctgcagctgacctattatggtaactaacacacagactatgagggcagtagacttacatatccaagtgtctatattttgtggacctgctggcatattggctggtagactgtcttagatgatggtggcagagcagtaagtcttaccatgttttctggggcattgcgtaggattagtgtattaatcaggattctcccaaaggacagaactaacaggataggtgtatatataaagaggattttattaaggagtattgactcacacgatcacaaggtgagatcccacaacaggcctgtaatcccagctattcaggaggctgagtcgggagaatgcttgatcctgggaggcagaggttgcagtgagcaccactccacaccagcctgggtaacaaagtaagactccatctcaaaaaaaaaaaaaaatctgtgggcaagtgacaaagccaggacttacctatggatttcttcactcagaaaatactcctcttacaaaaaacaaaataatttccaaataggggaaaactaggggatttattaaagttggaggattagtatgtaactatttttttcccaaagtttgccagagtaaagtctaggcattgtagctgaatccataaaggcatataaaaaaaaataataataataattcaatgcattcaccccaaggagggctagacaatgaccatgaaaacacagctatccgttttagaagtggaaaattctaaaacctcaaatgtatttttaaatgatctttcaagcatgctaatgcctttcatagggacggagacttctttctatatttttgctatctgtggctctctatggttatacaacgggcccacgtgttacatcttcctccttaaaaagaccaagtgcagtggctcacacctgtaatcccagcattttgggaggccgaggtgggcggatgaagagatcaagaccatcctagccaacatggtgaaaccctgtctctagtaaaaaataaaaaacctgcgtgtggtggcatgcacctatagtcccagctacttgggaagctgaggcaggagaattgcttgaacccaggaggcagaggttgcagggagcccagatcatgtcatcatgccagtgcactccagcctggcgacaaagcaagactctgtcttaaaaaaaaaaaaaaaaaaagaaaaaaattaaagtaagctcctggaggagagggttcatttctcctgctgctgtggactcacccaccagcccaccagcccaccagcccagccgttcatgtggtcattctttcagtgcctcttacagcatccttaggtgtcatgggcacattgctcaggattacaaatacataaatcaaattctgtgcaccaaaagcctgtctatggggagagacacacgagtaatcttgaatttctgagctgaagtctgtattaggggagaggctgaggctgtgggtatagaacaaataagttgctaaactcagcactgcatcttcaagaatgcttccagtccatccctgaagatgagaatgcagcatggttctgcacgtggacccgcgaggagcggtggtaaattaggtggacagactcatctgtgccaggatagtaagaaattctgccaaggacatgtttggtgctatgagcgtggttggggccacagtccaggcaggatgagaaatatgaggaggtcaaatcacagagtaaaagtaactctctagggccacatagtggatccacggtgatggggaatgcccagggagcggggcctggagaaatgaaacgttgtaaactcatgagtcctcactgtgactgtaaaactgcaggtgaaaacttttaccaaaaatcatcatataacaaccgtttttttttttttaatttgactttctaacaaaaacgcaaattctgtggcgataaattgcatattacatttattatatttttattttattttatttattgttatgttatgttatgttatgttatgttatgttatgttatgttatgttatgttatgttatttttttagagatggagtctcactctgtcacccctgctggagggcaatagtgatctcatctcaccacaacctccaccgccccagttcaagggattctcctgcctttgcctcctgagtagctgggatcacagacatctgctaccatgcccagctaatcttttttcatatttttagtagagaggggtttcaccattttggccgggctgatctcaaattcctgacctcaagtgatctacctgcctcggcctcccaaagtgcagggattacagccgtgagccaacgtgcctggctggccacagattttgagtaaaccttctcttcttttggaggataggtacagatcatttccaaatctataacatgccagttaaggaatttttttttttaatactttaagttctgggatacatgtgcagaacgtgcaggtttgttacataggtatacacatgccattgtggtttgctgtatccatcaacctgtcatctacattaggtatttctcctaatgctattcattccctagcctctcaccccccaacaggccctggtgtatgatattccccttcctgtgcccttgtgtcctcattgttcaactcccacttattactgagaacatgcagtgtttggttttctgttcctttgttagtttgctgacagtgatggtttccagcttcatccatgtccctgcaaaggacatcaagtcatccttttttattgctgcatagtattccatggtgtataagtgccacgttttctttgtttggtctatcattgatgggcctttgggttcattccaagtctttgctattgtgaatagtgctgcagtaaacatacgtgtgcatgtatctctgacgaagggctaatatccagaacctacaaggaacttaaacaaatttacaaggaaaaaacaaccccatcaaaaagtgggggaaggatatgaacagatacttctcaaaagaagacatttatgcggctaataaacataggcaaaaaagctcatcctcactggtcattacagaaatgcaaatcaaaaccacaatgagataccatctcacaccagttagaatggcaatcattaaaaagtaatcctgcctctatatcttacataatctgaaatgtgatttttttatcgtatgttattcttctgcaagagagtcaccagcattttttgaggcattattttgtgccacgtaatgtgttaagcaagtgacaaatgttgcttcatttgacctctttaaagaccttctaagattttctttcctaagacctcattttcagagaccctgtaagatgatattgagggtgaggggactgggctgagtaacttaccccatgccaggccaaatcagcaacagagcctgcgctcaaaagacatttggacttcaagtacccatgtgctttctctactgtcctcccccaagctccggctgtgttgctctttcctgtgacgggaatgggaagacagaggcaggccatgtggagtgagaagcctgggctgcaggcaagggacgcggcgcagaaggcaggagtcggccacttctcctgccgactccctgatgtccagccccacagtacagcacaccctacttgcctcagtgttttcacaaaagcatatacacagatatgtattctctgtcaattcatgtccttatgttcaggctggaatcatttactttctcctaatgaattcattttctttatccttaccggtgtttcactgatgtagaggggagaagtggatacgcgacttgtatacgtcaattggagagatgcatttgcaattttttgacacacttaccaagtaagaaactgcacatgggagaggctgaaatgccagcaacttaagcgttgccctcatcgcttcactggggcatgagttcccctttaccatggccacagagttgggtccaacctgataattgcttcctgaacagctagcctcacacctggctggtgggctgacagacgtgtgctccaggacagaaggcatcaagcagaccccttggattctagaacaaaatatcactctgattattctgttaattaataggaagcaaatagccctgcagttgaagatgattaagcatcttttgttttctttttgttaggttgatgatatcttatagcttcttccctttcccagattagatctgttatatccactagatatagcttctaacatagaaacagttatagaaaattggaattgaataaaatttagaggcaatcttggtagaatagcctaccttcttcattttaaagatgaggaagctgaaatgaaaaatagttcaacgacttgtgcaagactccttgcctatagaaggcagaatcaccaaaacattgtcctgagaaaattgtctaaaattgtatttaatagcaatggattattttttcttatgacaaagttgacttggctaaagaaacagtgaacgtaaaatgatttactataactatgggtgggggaaaggcttaaatatattttttagtcattgtccatgctttaatctcctttcatctctgtgtttgtaaaggggtccagataatattgtttctctaattgcccagatttccgaaaccaatcactttcttgacatagaaacttttgagttgaccttatctactgaatacttagagtaaattctcataagaatcctactgagcacgcattaattttgtccccaggtaaagaggaggaaactggcacatggaccgctgatacagtgtcttgcccaaggtcagatagcttgcaagagacaaagctgggatttgcactgagatattctcacttaagtctgagctcagaaatactaagcatgaggactttaagttctcagacttttaaaaatttatgtgcaagggtccatggatcattcctgtctcatggctctaactggtcacttttgtcaccgtttcccagtgtaggagagtgacagctgatgtgtctctttccataatgggaaaagcgtaggtggtggagcattacggaggcgttctgtcctctattcggtctaaatagaatgataattttatttgttttaaattttaaaatattcatgacataaaactcgcagaaaattttccataatagataagctggaagtacaataaaaccgactgaaggagtgattgaataaatcagtgattttaaaattttctcacacatcgctaaaataagtgtctcagttcattcatctgaatcttttcattcttagtgtttagtatttctttaaaaaatattctattttttcttttttttttattatactttaagttctagggtacatgtgcacaacatgcaggtttgttacatatgtatacatgtgccatgttggtgtgctgcacccattaactcgtcacttacattaggtatatctcctaatgctatccctcccccctccccctgccccataacaggcccccgtgtgtgatgttccccttcctgtgtccaagtgttctcacctgccctgggggagggggcgcaggtgagccaggatctatgtcttgcatcatctgtcacagacaccacttaagtgcctcaaattcctactacctgctatttctagacaaccaaagagacaaggaggttggtcattgttcaattcccacctatgagtgagaacatgtggtgtttggttttttgtctagaaggaaacctaggcaataccattcaggacataggcatgggcaaggacctcatgtctaaaacaccaaaagcaatggcaacaaaagccaaaattgacaaatgggatctaataaaactcaagagcctctgcacagcaaaagaaaccaacatcagagtgaacaggcaacctacagaatgggagaaactttttgcaacctactcatctgacaaagggctaatatccagaatctacaatgaactcaaacaaatttgcaagaaaaaaaacaaacaaccccatcaaaaagtgggcaaaggatatgaacagatatttctcaaaagaagacatttatgcagccaaaaaaacacatgaaaaaatgctcatcatcactggccatcagagaaatgcaaatcaaaaccccagtgagataccatctcataccagttagaatggcaatcattaaaaagtcaggaaacaacaggtgctgaaaaggatgtggagagataggaacacttttacactgttggtgggaatgtaaactagttcaaccattgtggaagtcagtgtggcgattcctcagggatctagaactagaaataccatttgacccagcaatcccattactaggtatatacccaaaggattataaatcatgctgctataaagacacatgcacacgtatgtttactgtggcactattcacaatagcaaagacttggaaccaacccaaatgtccaacaatgatagactggattaggaaaatgtggcacaaatacatcatgtaatactgtgctgccataaaaaatgatgagttcatgtcctttttagggacatggatgaagctaaaaaatattcttagtaatgagatgagtaaaggcagaagttttcctttttacttctacaaaaaaaatattgtataggttacctaatgttacaaaatagatttcatgatgattcacaattgagttcccctctaaaccacttaaatcaccacttttccactatgtaaattctgtttattcaatttctatgatttttataataatagtaattatcatttgtaaaactgtaaccatgacaccaagctctatgttaggcacttggtatatacgtttgttcaattcttacaacatcttgtatgaaaatgtatattagaaactctatatcaaagataagcaaaacttcctaaattagttaagtgtgaacatcaacacatttattaagtgatgttgccaatatttattttcaaattatccgacatcaaatagtgtcattacacttttatatttattttagttttatggtgtttttaaaatttaagaccttgaaaagcatttaaaaaatccaggtgtggaggaagtaaatcactgccaaccatgagcaaccttgttgaattatctcgaaatctcctatacagtcaatcattgcctcctttcttttatcttcatgacaccccaaattcggagtttatttattccagaaacttactgaatatgcagatgtaagttttcctaagaaaaatattagcatgcttttttgggagacatagagatatttagaggcgtggttgaagatgaatgaaagatgagggaatgaatgaaacgtaaagtatctgtgtaactgctgctccatagagcattattggaagagtgactggaagtaacttattccccctttctggccatgaccagtggtgagaatgtgagtacttacccattcggcaccttctcctctctacacatgtgtaaaaacgtgtttactcccctacctccagtgttcttgttagcatgcaaactccggcaagcctccttgtctctttggatgtctagaaatagcgggtagtaggaatctgaggcacttaagtagtgtctgtgacagatgatgccagacatagagcctggctcacctgcaccctctcccccagggccgtctccctgacagctcgtcctggggctgggggtgttcagagtccttgagtttcagctgcctccctggcacttcctctgctggccgccgcacctatcacctggcctccgatgagacacctccttatgagaacacagccccagggctcaaccccaggaggaacttggttgccctttctacatttgttaaattatattgtttaatatgtaagaataaatatacatacgtgtatttttatccactcaaccctcttcctttctggtttacataactttttggagatcattctttttagtgtatttgtaaagaacctccttaagtaactgttttttaaattaatcttattatttgaagttcacctttcagccaagttggtgataaggagtgtgttgatacgatacctgagacatttaaaaatctgtaaatattttctcttccttctcacataaaatagcctgtttgctaagtagacatactaagcagaacatcgttttcccttctatccagtgctcatagtgttgttggtccagtacctctacggttttgttatgctaccaaaaaaagacaaaactaactttgatttgtatttcctcaaatataatctgcttgttcttctgggtttgtgtacagaattcttctggtgttgttagtgtgaattctgtgaggtgacgtattcctattattgtcatacagctttatttcatttacaggggccataatgaagcacttttatcttccttctcaactctttaatcagtcgtgaaagtgtatcttccattatttttctaattattgattctgcgcccataattatttctcaagaaacttcaatatcttttgctttcatgtagtgatctataattttctctcatcttcttttcatcttttgctccttcaaagtttcagcggtcactccacacatctttggttgattgatgtaaatgttaattctgcattttatcgcatctaacagtgttctggtttattctatatccattattgcattgcgacttttacattcccagtctctcattttttaatacttactctaccctctttcatacatctgagggcagatttcaataatttactgaaatctgcctgtgatgcttgggttactttatttcaggggttacagaaattctcctgaaattctcactagcttattctcccatcttatgcagcaaaactttttttttttttaactgtttctccatcactgttttgtttgcttactttccctggtgcactggttaatctttgttgttgtgcttaagcattttctatctctgcccatttcactggcattttgacgggttctgcttcagaaattttccttgccacatttgccactatcattttcacatgactctcaacttgctactctcttgaaatttaatgaatctcaccttactcctcaagcatccacaatttcttcatctaagtagtttgtgaaaaccacacttaagagaagcaaaataccactactgcaatagagaaggaagggtgcaggtgataaaatttgccgggaattcaaaagataagaggtcattttagataaaattggagttagaaattgcagagtcagagagaagacagatgagtttttcttggttataaagactcgtgagatttgaaataacagaatacttcaaatggtggcagaatgtgcctgggtctggcagacatgacaaggtttttatgaagggttgccatgaggataataatgaacacaactgccattgatcaagtgtctgctggatgccaagaagaagtacacaccttgcttgcactgcattcttgaatcccagaaatcccccagggaaatcggcatcattctcattttacggataagacagaagaaaggttaaacaattctttcaagactctcgttgagtaagcagcaaagcccagactctctcttttgtcagtgtgattgtacttgttcacttaaaaaaaatgtttttttaaagaaattgttaattaatacataataattgtacctgtttatggggtacatgcagtgtttcaatactggtatacagtgtgtcattgatcaaatcatgggaattaacatattcatcacttcaaacattcatcatttctttgtgttggagacatttaaattcctgttttcttgctattttgaaatacacagcaaattgttgttcatgacagtcaccctgcagtgctgtcgaacactggaactgattgcacctatctagctggactttcataccccaaaatcaaccacttcttgtccacgccctaacccccgcctccatattctcactcatgtggaagtttaaaaagttgatctcatccaagtcgagagttgaacagtggctaccaggggctaggaagagtgtgggggttgggggggggcaaggggggatggggggagatggagggcaaggaaagaggggggctgctttttaggccattttgaaaccacaggtgggctgagacagggaaaactaagccaggtcttctcaggaatcctttccagtggatgggggacatccagcttctttagctgtcttgagctgagactaattctctctgtagcagggcagcacaaagagaattacggtaatttatgtaccatttaaagctgacaaaagggacttggcagggccctgagggcggggatgtcagtaatacttaaaggtccagagaaccatctgggagattttagcatgaaataccaagtttcttggcttcctgccagctgatgccgccgtcccaagactgctgtgttttagaggaattgcgcttttcactgcctgtgcaaactttatttcccaccctgaatcactagcagctttgactttttgtagcataggctaatagtcatatagttacatttgaaataatgtgtgaatcctcttcttcatagcagtgcattgaattgtagtttataagagactcctagtgtttatatgtggggctaaacatctcagataaagcaaggatatcccagaattaatgacatatttttctaactccctttctttgtgtgtgggtgtgtgtgttcaaagtacttttttctaggttgaaattcagtctttgtaatttcacactgtatactgtgggctattggtatgtgttgcatacagatataaaagcttatatgtgtaatttttgttaatttattaggttttatttttagagcagtttgcacagcaaaattgatcagaagacatagtttccccgtaccccctgcccccacacatgcacaacctccccactgtaagcatcctcaccagatgctttcagcatggtgtgtttgttacatttgatgaacatgcattcatgctgttcatgcatgatgaacattgattcatgctgaattaccaaagtccatagtgcacgttagggctcactccggctgctatttactctgtggatttgggcaactgtataaagtcagtgtccaccattataacatcacacagagagtttcactgtcctaaaaatcctctgtgctcctgctcttcatccctccctcttctaacccctaacaatcactaatctttttactgtctccatagttctgccttctccgaaatgtcatgcagttgaaatgttgcaacacgtcaccttctaaaattggcttgtttcacttggtaaaatatatttagttttcccccatgttttctcatggcttgacagctcatttccttttagccctgaataatattccactgtctggatataccacagtttatccattcacctgctgaaggacatattggttgcttcctaattttggcgattatgaataaagttgctataaacgtacatgtgcagttgtttgttgtgtggaaatacttctttttttttttttttttgagatgaagtctcggtctgtcccccaggctgcagtgcagtggcgcgatctcagctcactgcaagctcctcctcctgggttcgcgtcagtctcctgcctcagcctcccgagtagctgggactacaggcgcccaccaccatgcccggctaatttttttatatttttagtagagacggggtttcaccacgttagccagtatggtctcgatctcctgacctcgtgatctgccagcctcagccttccaaagtgctgggatttgtgtggacatacgtttttagctgttggtgttaaattccaagatatatgattatttcattatttgataagcatatagttggttatgtaagaagcttccaaagtatcttccaaagtgactgtaccattttgcattcccatcagcaatgattgttgtatgtgttcttttgtaggaaatttaaacgtatatttatccagtatctatggtagatatatttggtcagtttgtctccttatcattaattacatttttagttgttttatgattggcccttacaacctcaggtgaaaacaagtaaaattatttgataatatttattttctaagaaagtgtgcattttcttttaaaatgtgtaatcgttcttcttgcaaccgtgttaataatttccagacataaacttgttatcatgttttttatgaggaaattcactgtttgaaaggcctttcttctgatacataatttgaagtggaatgaatcagatacattatagcgtcagttttccagtgttccttccagtgtgttctgagttgtcatttctaacccattaatttcaaacctacagttattaattaaagcatttataaattatcttattccaagatgtagggtcttggtactgatttatattgtgctgtcagttctaaatcttggaaaattataaaatatttttcctattcatttgcctgccatcacagtttctgacacaaacatgttattcagaaaaacaaatgtagtttacggaagaacatcaaaaggaaaaacttaaaaatagtgctatcaaggaagaaacccaatgatgcatacatttttcttggggtgtgtgtgtatgtgtgtgcatgtgtgtttctgtgcctgtgtgtgtgagcatgtgtgtatgcacatgcacagaggcaaagatcatagagatcagttgatatatttggattcttttggtttaactgaatcaggagaagtggtctctctatttgaatggacccatatcaaatgaatttttttcagtaaattgaaactatatagtatattttatttttgatttttgggaaatcttttcattttgtttataaattaatattttgtcaaggaaaatacatattatttgaatcaaagtagcaacaatatttctttcctgcaaaatcatttatatacttattgaatcattcttattctcttgcaatattctccattaaaagaaaaaatcctctctgacacattcttacttctcttcatccatgttagttaagatacctgagagatctgcagaaccacttactccgcttcctcacatcccattctgccaatccactttagcgcttcttccatgcctacaactctgctgttctttcttgccatggttatccatgtcctccatccagtcaagcccacacgtctcatcttagagctcatctaattcacattcttagtagcattcaacacatgtgatcactccctcctccttaagatctttagttttatggatttttcacaaaacaccatattcttggtgtcctccctaccacagattcttttttctttgtcatttcttcctcaattccttgacctctaaatatgaaagagactgcagctcatcctcattcctcttcttttcacgtgccttcctttgatactctgacagagtcttagtattttaggtggcatctgtggttagggacccccatttctgtgtgtctggtcgtgaacctctcccaagctccatactgtttttttctaaatgctcactggccacagtggcttgacgtaccatctagaaatgtctaaaagtcatgcaaagcttagcagacatcgagatgtctagctagagtgcccagcactttcctccttcacaaagaggaaccaaaatgacaagtaggtaagcacatgtcaagtgcagtgtctaggggagaacactgtactgaagcaacagagtaaagaagaccctctaaggcatggaaactcaagatggcagcataaagatgaacgtgaagtgcgcaggtaggatccgttcagtgccaaaaaaggactcccgattgtagggagaaggtaagtgggagatccccagcaggtcacactcccaccccagatgcctgtattcagggcttcagaaaagcccccacaggcctcataggccctgagccaagggtagggagctacctgcagcccacatgactgttttgctccggggagagaactcacaccgggttcctctcttgttctctgggcctcaggctgctgcagcatggtgccattttcaggacagaagaactatcagagtacatcctgcccacagggccagtagcatctccacatcttgagaacgcagccatcatcccaccacagccaaggagaaggatgcaggactatgaccccagctgcactcagtgacacaaacctgaacccagcactcaagaccatgaagtaccctataccacaagtcgtcaagcagagtcgggaggccactctcaagacagggggagccaaagtgcatgctcccaagaccctgagagctgaattcttgaggcacactaccaacaagcaccctggatatatgcctcttgcaggagaccaaggactggccttttgggtactgctgccagcagtgaacactccccccactccaagcagtggagttgctgaatgctcacacatgctccccagggacccaaggaccagcccacctgaggccaaccactgccagaaaactcattccactgagaagcagagatggctcatgtgaccttctatatccccaaaacaaggccaccccaaagtctccatctgcattagagctgaaccaacacttccacaaacacctgcagccaaggctactcagacagctacaaacatgcagacattgattacaaccaaataaatatcatgaagactgcactactgtactcatgcagaatacaaaccaaagcaccctacccaactgacactatgagacacatctacaggaaaaagttttttcctactaaaactacattctaatattaggagaaattgttttgtcagatgtatagatactaatgtaggaacacaagaaatgtctaaaaagcaagaaacatgacacccccaagggaacaaaatcattttctaattccatatcccaaagaaaaggacagctacaaaatgcctatatgatttttaaaataatgatgttaaagatacgccgtgagaatcagtagaataaaaatagacaattcaaaaagtaggaaaacaattcatgatctgaatgagaaattcaacagagatattacacaaaaagaactaagcagaagtcttgaaactgaataataaaatgaatacaatttaaaaaataaaatcaagagcttcaacaacagactagatcaagatgaaaaaagaatttctgaacctggagacaggattttcggaataagccagtcagacaaaaaagaataagtaagaataaggaatgcctacaaaatgtgtggaacaaaatgcaggggacaaatattcccattatgggagttctagaaggagaagagatcagaaaggtgtaggatatctatataataaaataacagctgaaaacttctcaaatttttggagaaatatgtgcattcagatccaggaagctcaaagatcaccaaacagatctaatgccaaagatgctctccaaagagcattataatcaaactatcaaaagtcaaagacaattcttccttctctcctggtgattttgtaattttcccaagaaaaagaaaaaagaaaaaattatttgaggtgatggatatcacagttctcctgatttgatcgttaaactttgtatacatgtatcaaagtaccacatatacctccaaaatatccacaccttgatatagcaatataaatacataataaaaaacttcaaagacaaagagaagtctaaaaacagcaagacaaaacagtcaagtcaaatataagcaagaagctcccagactaacattagatttctcagcagaaccgttacaggctaggggagaacagggtgatataatgaaaatgctgaaagaaaaaagaagaagaaatgtcagccaagaatactatacccagcaaagctatacattagagttgtaagaataaaattattcccggatgaggaaaagctaataaaaatttatcactactggaatggtcctacaagaaatgcttatgggagcccttcatctgaaagtgaaagggtgataaccaccattgtgaagacacacaaaagagtaatattcactggtagagcagacaaataaatgagaaagaagtaaaaccatatcactacagaaaaccaccaaaccacaaaaataaccaagaagagaatgagaatggaatagaggatgtgcaaaacaaccagaacagaaataaccaagtgacaatataatttaaaaagcaatatctaagtgcatactgcctataagaaactcactgcacctgtaaaggcatagactaaactgaagacattacaagagatagtccatgcaaacagaaaccaaaaactagcaggaatagccatacttttatcagataacatggactttaagtgaaaaaatgtgaaatggctgggtatattgaccctgtaatcccagatacctagaagggtgagacatgagaattgcttaaacccaggagacaggttgcagtgagctgagattgcaccactgcactccagcctgggtgacagagcaagactgtgtctaaataaataaataaataaataaatggaaagtgaaacaaatgtaaaatgagacaaagacaaaaataatgtataacaattgtaaacatatatgcacccaacaccagagaccccagatatataaagcaaacattattgatgggagagatagactccaatataataatagatgtggacttgaacatcctgctactctcagcatggaacagattatctagacagaaaattaataaagaagtgttaaacttaaactatagtgtagaccaaatggacctaacggacatttacagaacatttcatccaacagctgcataatacacatttttctcatcagtacatggtatgaatattcttcaggactgatcgtatgttatcccacaaaacaagggtcaacaaattttttaaaaatctaaatcatatcaagtatattttttgactgtaacagataaaattagaaataaataacaagagaaactttcaaaattgtacgaatacatggaaattaaacatgttcctgagtgtccaatgggtctatgaagaaataggccaatgggtctataaagaaattaagaacaaaatttaaacataattttttttttgagacggagtctcactctgttgcccaggttggagtgcagtggcggtggtgatctcaggtcactgcaacctccacctcccaggttcaagtgattctcctgcctcagcttcccgagtagctggggctataggcacacgccaccatgccaggctaatttttgtatttttagtggagacagggtttcactctgtttgccaagctggtctcgaattcctgacctcatgacccaccctcctcggcctcccaaagtgctgggaaatgaaaatagaaatacaacataccaaaacctatgagatatagtaaaagcagtgctaagagggtagtttatagcattaaacacctatatcaaaaaagtagaaagatttcaaataaacactcctagctctgtggcctggaggagttgatgttcagtgagttcttgtaggttgaggccagtgcttccctccacgagcaagccacatggtgtctgccctcaatccttacagggagctctgcagggcaggcagaacagcaaaccaaccaaaactgccaacacagggaatgttatgaaggggataggcaggattttggcaaagagactggctttcttggacagagtcggcagtggagccatagctgagggaggaacattaagcaggcacttaagaaaaatggcaggagtagaaaaccaaacaccgcatgttctcacttacaaaggggagctgaacaatgagaacacatgaacacagggagaggaacaacacacatcggagcctatttcgggaacattggttggggaaagcttcagggaaaagagctaatgcatgctgggcttaatacctaggtgatgggttgacaggtgcagcaaaccaccatggcacgtgtttacctatgtcccaaacctgcacatcctgcccatgtaccccggaacttaaggaaagataagataattatatgtaaaaaaagaaatatggagcatccagctccaggacagctgagggagtccatgcaagacataaggagggtgcatatgctgtaggaactaaaaccattttggctcaatgtcattaaagttgctcacaacttgaaatgtattatccttttgtcttcagttttcatttgcatctctggttcttttactctgaaaggatggtatatgtggttaaaatacacatacttctattttacagctgcatatatttgtaaaatgccatatgacaaactaaaagctgtctatgcaagaccaaggctgcattttctgtttttactgagcatcagcagcgtggagtaaagattggtgtttgacaacaggacctgctgattgttgagatgaaatactgacaaagactttctctgtctacctttgccttggcttgaaataattacagaatggccctttttccacccctaatgagagcccattcatatagtgtgacccctatctgtacacattgcaaatcagccaaacatgacacacaaaccttaatgaattatcatcgcttcccaccagaactttaaacaagtcaggactgagttaacatgtcggaaaggaaaccagcaggtctcagtgatgattctttcagttttaaaattgtctgattatcagatgatggtcacttataaattggttcatgagaaacaaaaagtagaaataaaaatatcaggtgctacgtttaacatgcagtatttatactggtttgcaacagctatcaacctcgacacctatttcaaatgagattgctaaaataatgtattcatacaaatactgcaatttgaaatagtaggttttttaaataaattataatggctatattaataattttagtaagaatttcaagtagcaaatgtaatgtattcctttttggcattgcttggaaaagcacctgtttagagcctgttggaatggtggacatggacttgggtattagtgggaagtctgtcttctctatgctaccacttactcttttctttcaagcttaacaaacaggcatttgatacttttctacgctatttcagaatttctgtttcattctaaaacacagtttattaaaatgtacttccagtattatggtttctgttcctcctgtcccttctctcttccgccttcctttctcacaccctctgcgtctctcttgttacatctctctctctctcatttatatattcatgtatctgtgtatcgtctgtcatttttccatccacccatccatccatccagtctgtcatctatctactatctgtcatctatctatctatctatctatctatctatctatctatctatctatctatctatcatctaatctgtctgtatctgctaatcttctaccatccatctaatctatcatctatctatcattcctctaattatcatcatgtatttatcttctttcctttttctccttactacccagggttctagcctaactttttcttcctcatagtattggccaccaaaggaagcatttcttctttcaggagaaaaagatcttgtgctctacagaaagaagttaatagattataatatactggcacatcaaacataaaccattgttgtacagatgtcttggtgctgctcatcatgacaaagtattctttgtaaaaaaacaaacaaaaaacttacaggctttgcaagactaaatatagaggagagctttgtatcctcataaagtcttttggggtgctaatatggataattccatgaagtatgcatatagaactttaaaaatatttattgcagagcattctggatatggtaaaaatatatgtcattaactataaccaacatttcttttgctaatattgatttagttaagcactgagaatgttaaagtaaacatttagtagatatttggcttaaagtgttgcagaggttaaatttcatttttagaggtgaaaatacataagttgggagtaatagcaattctgaatttcataaaattctataatgccaggctatcaaatatatataattatccatgtaactacttaaagcagctctgggatcatttgacattggcattaaggagcaaaatttaacagtataactagatatttgcaatacctattaaaagtcatgggaagtacctgttgttctaagtcactgtttcgtaccttgtatttaggtcatcaagcttgcctttgaagagtttgagctggagcgaggctatgacaccctgacggttggtgatgctgggaaggtgggagacaccagatcggtcttgtacgtgtgagtatgtccttgagcttcttcttctcttatgcatgcagtgcggggcacggtgggtggagatgagattctgctacaggcttgtaattcggcctcaggtgtttgcttagtgccatctatggctaatgtagtggcctgcaatctcattttgtatgagaacacattatgagtataatttaggagtatgtgttatctgtttcgactgtttttcttcaattattaaaaacatatatgtttatggcaaaaaattagtatactcatgaggtagcaaaaaacaataaatttttcaaatcaacccctccgccccccctttttttttttttttttttgagacaggttcttactctatcacccaggctgcagtgcagtggtcagatctcggctcactgcaacctccgcctcccgggttcaagcaattcacctgcctcaccctcctgagtagctgggattacaggtgtgtgccatcatgccaggctaatttttgtattattattagagacaggcgtttgccatgttggcccggttggtctcgaactcctgacctctggtgatttgcccacttcagcctcccaaagtgttggggattacaggtgtgaaccaccgcacccagccaacacctcttttttaacctctctcctctgcttccctgtgatgttatattatcagggtttttaaagaggtacagatgctttctagtctgggaaatacaggtcttttttggaataatgccatacacctttccagacttcctgtaaaactgcgtaataaagtaacagacatgggggggaaaagtgttgggggtgactcagtgtacctttgaagaactctgattccagagtcttagcaaacacggtgacagccttgctgtgaatatttgcagactgatcccacttctcagttttcaccaggatcacagactgttctgcagccttatgacctgggcatctgcttcagctacttccagagagagggcctcaaagacagtttttgtccattttatcacacctggtttatgaaaattaggaaaatgatttgagggtgtacttcctctctgtttttaagagaaaggaaatacctgctcttatctgcctttgcaactccacagatagcttctcttcatgttgtagatcttgaaaccactaaaccagaagcgtctttcattaatggaaagtgttctgcaggtgttcaccttgctttctttgtctacttatatactactgaggatgcctctttgtgggaaagagagtttctgtggtgccagatgagctggtctgccctatgtgagacacccatggggagccatgggcggcttctgaggagaaaagtctccttatttccttcatgtctttatgctctgagagcagaagagctcagcggcatgccactggttgcttggggaaataacactccactgaagcaatggagaataatcaaacatcttggcttctcctgaaacccacgcccacccgtttcagtcccaataggttaaagatcttaagtagttcagacacacgcctttgctggaggaaattcacatacaccttgttgaatgactcacaagttctccttcactgattaatccttttcctcatcccttcctacccctcccatttgccctgagaacaaagagcttgtaaaccaataaattgggtggaggccgggacctctgggctgtgagcaagcctccggatcctcaggtcccctggacccgccttttaaactctcattctgtctctttctaactcctttgtctccgctggactcggggtacccgccgggtggtgtggggctggtttccctaacactcttcatttgtgaggaatcttgccccgggtagcatcccatatttccatgctagtaaaaagatgcagtctgttatactcaccttatccccttatttattgattacttatgagataattcacacattgaaaaagcactagccaactgttctgtatattcccttaaaaatcgatggacccagaagaggactccaccagggacacgactccttcattcgtcgaatcttggacattttgcaagagaacacctccctctagcttatcttcctgctggcccattccaactattactaataagcataattgaaatcatgttgctggaccacaacttattataataatgatgagaataacactagtaatgtcctagctaacttttatgtatcttttacgcaccatgcactgtgttaaatgcataatacattttaccttatttgatctttactataatcctgggaatttgggtctaataatatcattgctttatcattgatgaagctgaagttttgataggttaaaggatttaccccagttcacaaacctagtgtacattgaggcagggattccaactcagtgatgtgatactgctccaggatcttgagtctttatcgcctgtggacctaccatgctttttacctggttccctttgacagtcttttgcatctgacactcacgctctcaccgcattctttcacttctataagcagctgtgaagtgaatatctttgtatgtagacattggcatacttttttgctataccttcaggaacatttccattgaggaatttggggatgaagaggcatcttcatttacattgttacgtttctccaattatcccccctgaaaatttatataaacctcagtggaacatgaaggatcctatttttctgcacccttgccaaataatgactcttttttgttgacaaattactaggtaaaaaaaaatttttttctttttatttttaaaaacagagtcctacatctgagggcccagatatctatattttgggcaagcttctaaggcgatcgtcgcacacactgcctgcctttgacctgggacagggttgggaacagcactacagtggatagaaaggggcctgcaagtcaaagatagagtttctggctccagctatttgctatccccatgaccctgagggaagtcattttccttctctctgcctgtcttttcctggctataaaatatgtataataaacttttccagcctgtgggaaatagaaaaatgaaataatgcatgcaaacactccggagagctgaaaaatgtaacccacacgtattattattaccaaaacacctaatttaagagaggatgtcactaaaataaatgagaaaaattgttaaataactgcaaaatttaaaatataaatgcaggcaggtaatgccttatgaaatcccttaggttattattaaagatctaaaatcatacactcattttttaatgctatttgttgttaagaaagcaattgcaaactatgtattacattgacagaagtgttattagcgccttctctcaatagcttgaatctgtaaatgaaaaactaaacagccaactgaatcaaactgagatgccctttgggaaacataatgcagccgggatcagctgggcatttaatcagctgcagaagaggaaagaaaagccactgatatatgtccttagtgtaccagatcacagaaaaataaccgaacacagagaatcacagctagtctctttgaataaacagataattttaggcgatacatcgacaaatacttttgagtacttatatgcaaacattcttcccagcatggagtctatcatctaattggagaaatgacagatagactggaatagtttaaatactagtcagtatacgaagtcagaggatcacatgacacacattttacataaagcagcagtttaaaacctcttcatggcagactggcattcactacttcaaactcaatattttgtgggtttccattttgtgggaaatatggaattctagttacatctcgattttaagagaaatttggaaaatgaaatagcctaaaactatatagctcaccctaaatacggttttaaaaattcttatttctggcaatgacttctcattttgttaatttttatggcacaatataaaagaataaaaacatgaagggactccttctgtaatccaccttccctgagaggtggttgaaggaacttgggtcatatttatagaatgtcaggcttaaaagaaagttaagtaactttctttgcaaatgtctgttgagttctttccaagtacatctattgagactgttctcgaatttgatttgtggaggaactgcatggagagctatggccttccctggattccctctggcctttgcagctattagccattggtaaccaggggatttcattaattcaggacgttctgtgggtggcaggcacaggttacagttttaaaatgcccgtccctctatgagaatgaatagtcaatattattagggacatctgtgagcaagtagggtagcctctgcctaaccagatgtgtggattaacaaatcaggatactggttctttcttagggctggattaatccatttttgctgaatctacttcttgctcccagacactgcctggcatggctgagacgtcatttctccctgttgttttctgctgatcctgagtcaaagggtatcattctctttttattaaaagactgctgaagagccattaaaaagcagacactatgcacagacgtgtgtatttgtgtgtgtatctttatatatctttaatgttatcacagagttaatcactaaacatgtagtgccttgggggaaagcataaacaattgatgttggtaataaagatataaagatattgacttaaatacattttcggttttaaaaaaatcagaaaacatgattagaaatcaaaccaaatagaaataagattcttaaaactctggaatcacatgatcccaattatttttctgtatattatctttcacataatggcactgcctttgagcctgaatgccagtgacagtatagacagactcaactgtttgaaccctgttcttgacttgaagtctatccattgttagcttttctttcccggcctcttatctggaagcgttcttgcttgattctttaaataattatttattgaatgccaaatattatgctaggactcagcgaggaggcagagagagaataagccattgtcctagccttgaggaggaattagcctactgatatacatttcatataattagcagtatgaatctacattattaatagtaagagtgctaatactgctataaattttgtattacattttatactgcaagaagcatactatcttccagatacatttatctatcggttttagccttgaatgtaaaaggtcaaaagacatgttattggccaggcatgctggtatacgcctataatcccggaactttgggaagccgaggagggagaaatacttgaggccaaaagtttgagaccaacctgggcaacaggatgaaactccgtctctacaaaaaaacaaagacaaaaattagccgggtgtggtggtgcatgcctgcagtcccagctactcaggaggctaaggtgaaagggtcgattgtgcccaggagatcaaggctgcagtgagctatgatgaccccactgcactccagcctgagcaacagagcaagacactatttcaaaaagaaaaataataataataataataataatactatgagtttctaaacatttatttggtttgagtttagaaaaaaaaagtcacctcttctaagtatattttgattgcgtttgtagggtcttttttttagtcttctgtgtctggaaagtaaattactcataaaatacacatctctaatgggatgcaaacaagtttaaaaacaaaaccattaatatcaaaatgttgatgggatcttgttagaaaaaattggtaatgttactaagtgaggtttcagcaatgccttgaggatttttacgatttctgggaaatcacaaaatattccatgggattcttttagcacttagtgtaatttgtaagcttccaggaactcttaaaaacattcacagctaatttcagcattaaaaagggacccgccttcttgacaatgtgtttgtaggcacctcctttgaaaattctatctggcaattccattattctaagtagataaacgttaagaattctaaatatttatacaccaaatttacccgatactttggtggatgtagaataccctccttgtgactagatgtatcgatttatatatgctattcctaaaatctgccttaaatttatactgataggccgggcatggtggctcatgcctgtaatcccaacacttggggaggccgaggcgggcagatcacgaggtcaggagaacgagaccatcctggctaacatggtgaaaccctgtctctactaaaaatacaaaaaattagccgggcgtggtggcgggcgcctgtagtcccatctacttgggaggctgaggcaggagaatggcgtgaacccaggaggtggagcttgcagagagccaagatcgcgccactgcactccagcctgggagacagagctagactctgtctcaaaaactaaataaataaaaaagtatgctgataatacatcaatcactgttgtctgaagagagcggcccagttactggaataaccaagtcatttctgtataatgctagtacactcttagccttctcctgtagtaatggttacttggcctggttagtagaatgttgttatgccaggtaagtgcttttgtgtcaccttctgtgtgtgagaggttcaggatcaactccccaggatcaaggaggattgagtagcaagcttcaggatggctagggctgcccaaccttcgtcattagtactggacagttcagacattgccagatctctctggacaccctgtgtggtttgggtttcctcttccaagaaccctgttggtagggggataaacaaaccactgggcttcagcattttggatttgggctagcagctgcagtggagctatctgggaaagccagcagagtcagggaccttggggacccattggatgtgtcttgagggcaaccttcctacagggaagaagaagccataggtcccacaggaatcggagcccgagggcagctgctgctgcaaataaggtggtgctccatttcagctaatctgggctccaggcagctgagtgaacagcaggagtcatttccagttgttctggctgttctatcacaggtgtagactcactgtggctattttctctgaggagccaaaaaatgcatgcctgtttttacagacccaaaagacccaggaatctcttccagaattcatcagtcaaaagcatttaaagatttttattgtttgtttttcatctcaaataaacatcgaaggatgctactattttggggagataagtccattaaaacaatagatgcatgcatttacagtgcaccatccctgactccctctcttgtgccttttaccctcaatggattgttgcatcaaatagaatggtagataaaaaatagttttaaaaagattaaaagtacagtacaaggagaaggtaatattgtattactatagttatcatcgctgtcttaatataataaaacatccagagttctgccatgttcagaatcaaatttgaaaatgaaatataacagaaagaaacaaggaaagaggagattgaactgtcatttaatgcaccagtattgtttcttgacaaaattgtgacaaagatatcatttctatctgccaagtgaagacaaggagaactcgaatcgatagtcactgaggaaaaaaatgctgcctaatcgctcattgaacccctggtgttaatacgaagggatctttatagacttcgtccggatctccagtggaaatgttttgcaaatctacagtaaaatgtcacaaccaggatattcaccttgatatgatccactgatcttattcagatttcctgttttattttattttattttattttattttattttattttattttattttattttattttattttattttatttttttgaggctgagtctcgctctgtcacccaggctgtagtgcagtggcacaatctcaactcactgcaactgctgcctctcaagttcaagggattctcatgcctcagtctcaggagtagctgggataaccagcatgcgccaccacacccagctcatttaatttcctgttttatttgtattcatttgtgtttctctctctccctctctctctctctctctctctctctgtgtgtgtgtgtattgttatgaagttctatacaatttcactacctgtttaagttcctgtatccgccacagtcaagacaggtaatttctaataccccaaagttccctcatattttccttaataatcatagccaactccctgttttctacacttaaagctgacccctgccaaacattatctgcactccagctctaaaaatttgtcattgcaagaatgttatataattagaagcacgtagtgtgttaccttctatgattgcttctcactcagcaaaattccctggactttgtgtactgcaatcgtttcctcccgttttttgctggctggtatttcaaggtatgaatgttccacagtttatattcacccacagatggacacctggattgcttctagtatttgactattatgaagaaagctactatgacatttgtgtataggttgttatgtaaacatgagtttttatttctcttggaaattacttaggagtgtaattgcttgagttgtatgttggttgtatgtttagttttgtaggaaactgctcagctgttttccagcatggttctccaacatcacagcccatgatgttaagtggtcctcatgctcacgccgtccccacaattggttttatcaccactttttctgctccaaaagttgtgtaatgacacctcgttgtggtttaaatttgcattttcctgatggctaatgatactgaacattttgtcagatgcttatttactatctgacatcctctttggcaaaatgtctaagtctttttcccattttctaagcggatgtttcttactaagtttggagaattctttgtgtagtcaagatattagtgctttgtagaatacatggtttgcagctattttttctcagtctgcggcttgtcttttcactttcttcatgtgggtttcaacacatggcaaaagcttttaattttgatgaagtctagtttatgggctttcccataaaggccagtgcttttgctgtcaactctaaggattctttgcctagctgtactttacagaggagtccttctatacatattcctaaaagttttacagttttacatattacatttaagtctcttatcccttttgagttagtttttgtatatggcatgagacagaggttgaggttcacggtttgcctggcagttcgtgtatccaactgttcagtagcatttgttgaaaggactcgcctttctccattgaactgcttttctgccttcatcaaaaactagttagatgtatttgtgtgggtctatttctgagctctctgttctgttacactgatgtgtgtctagtcttctaccaatgccacacattactaattactataactgtttagtaaatgttaatatcaggcggagtgatgtttctcactttattgttctttgtcaagagacttaactattctagggcaggtgccaatctatataagtttgagagtaccataaacatatatgcatgtatactcccagcaatgtataaaaacattgctgggattgtgataggaattacattaaagctattgataaatttggagaaaattgacatatttactatgttaaatctttcagctcatgaacactatgtgtcctgtgaatcgtcaaatgtttcttttttggcattagctgatatatcatgttctttctttagcctcttctaatggtggatgacattgattgatttttttaaaagttgactcagcctttcataaaatggaataaattctacttcatgattgagtataattgatttgtacattgttgcattcagttttctaatattttgttgaggatatttgcaactacattcataaaagatatcggtctatagttttctctttcttttttgtactgcctttgtctgactttggtatcagttgaatactatcttcattataagattataatggctataaaatattttctcttttgttattttctgcaagagtttatgaaatcttgacgttaattgttacttataaattagtagaattttctattgaaaccatctgggtctgaggattttatttttggtgaacatgttataccattaatttctataataaaggactatttagattgtctgttttatcttggttgagttttggtagttaatagtttttgacaaatcagtttatatctaataatatgttgaatttatgaatttacagttatttataatatttccttattatctttgtgatggctgatgaatctgtagtaatagcctctattttatttctggtatttgtaattgttcccttctatctctctctccctttctctttttctgactttctgcaagtgttcttatagcttcatcaattatattatttttgaaagagaatatttgtttcgttattttttctactgtttatctatttctatttcattaatttagacctctatcgcactcttcctcctagtttctttgagtctattttgcattacttatgctagaatcttgaggtaggaacttaagtaatttttttcattcttttctatctaatgtagtcatttactgttataaattttcctcttggcactgttttatctgcttcccacatatttttatatgttgtgtttttattttaacttcattctatgtatttctttatttcacttgagactttccctttgaatcatggattatttagaaatgtgttatttaacttccatatgtttagagatttttctactgccttttaataactgatttctagtttgattcctttgtgatcagagaacaaattctctatgatttcagttcatttgaatatgtcaagatctattatctggcccagggtgtgatttatcttttgtcagcttttcatagggctttgaaaaacatgtgtattgagttgagagttccatattcgtcagttagatcctgttggttgattgaatatcctttgtgatattttctgcctgtttgctaagggtgctaaagttttcaactatacttgtggaggttgctatttttctcttagctttatcagtttttgcttcttgtcgtgaagctctgatatttggtttgtacacatttaggagtgttacatatttctggtgggtcaatccttttattattttgtggtgtccctctttgtctctgatacttttatttgccttaagtctactttgtcagatattaacataggcactcctgctttttattattaatatttacatggtatgtcttttgtttcttttactatcaatatgcctgggtcattgattttgacatatattttaagcctcattatttgggtaattttttaatacattctgcctctctctgatatttcagtggcatatctagaccatttatatttaaggtaattattgatatgtttagtgctttgtctggcattttattatttctttatttctggttctcattccccttttactgcttttcttgccttcctaagggttattaagttttgttttttaattttatcttaacctgtttgtggtatatttcatgtatttctttgtagttttcaaagtggttgttctgggcattacaataaacatatgtgacttataacagtctactgatacatttatttcctactgttactatagaatattccacaaacttggtggctcaaaacagcagaaatttgtactctcagttctggaaaccagaagtccaagtcaggttttctaggccagcatcaacatgtgggcagagctgtaatcactccaaaggccctggggaagaattcatccctttcttcttccagcttagggcagctgctggcgttccttggcttgtggccacatcaacccactctctgaattcagagtcacgagaccatcttctctgcctgaaatctccctctgcctctctcttatatggatactagtggtggcatttagggcccacctacatcattcaggacaatcccccacatttcgatccttaacttaatcacatttgcaaaatctttcatctgaaaagtaagtttcacagatttgagggattagagtgagagcaggattggacaggagtgaggccattatttatcttactacaactaatgcgaacatttaccacctgaagtatggaaactgcacttgcatttagggccctttaccccttcaactttttgaaattattatctgaagtaccagacgctgttctaattgttgtttcaatcattaagtaagatttatggaactcatggtaagcaaaatagtccagtttatattgtatagattcctcttgttttttctcttttgaaaacacaggtaaaagtttcttttcttttctccttcatttcttttcaagaagaatgttcttgagccaaccattaagggcaggtctaccaactactctggtttttttttttttttttttttttttgagatggagtctcgctctgttgcccaggctggagtgcagtggctaatctgggctcactgcaagctccgccttctgggttcaaagcactctcctgcctcagcctccctagtagctgggactacaggtgcctgccaccacgcctggctaattttttgtatttttagttcagacagggtttcactatgttagccaggatagtctcgatctcctgaccttgtgatccgctcacctcggcctcccaaagtgctgggattacaggcgtgagccattgcccccagcctaccacctactcttaatttgcaaaaacaaattatacgcctgataatttttttaagttccctttatttctgaaggatagattcactgaatatagaatttgtggttgtcagttcttccttctggcctccatgatcccaaatgggaaaatcattgtcattgaagtagttttatcctgtaggtaacattttgtttctttttggttgttttttctgtctttagtttttaaaacttggattagatgtgtcttggaatggatttgtttaggtttatttttgagaggttaacttagatttttttgggtctataaattcacgtgttttgccaaatttggtaagttttcagcaattatttttttaaataatttcaacaccatcatctagctcgtctccttttggaattctaatgataaaaaatagttggattcttttttctatgtgtatttgttttgttttgttttgtcccacaggcctctgaagctttattcgtttttccttttaattttttatttttgagacagagtctttctccattgctccagggggctggagtgcagtggcacgatctgtgctcaatgcatcctccgcctcctgggttcaagcaattcttctgcctcaacctcctgagtagtagggactacaggtgtgtgccaccacacccagctaatttttttttgtattttaataaagatggggtttcaccgtgttgcccaggctggtcttgaactcctgagctcaggcaatccatccacctaggcctcccaaagtgctgagattacagatgtgagtcaccactcccggccccttttccatttgtagtctgttttgtctctgttgtttagtgtaggagaattccattgatctcaagttcactgattctattattgctcatttcaattttaatattaagcaaatctagctatttttagttttctcttctgttatttttagttccataatttccttttagttcatttttataacttatttctttacttagatttatcgttttttttcatctgtttgcagataatttgtaaatgatcactgaagcatttttaagcgacctggctttaaaatccaccctctgattcatttctgttggggttggttgattgtctttcatcattcaagccgtgatttccttggctcttggtgtgatgattgtgtcccagctcttttgtgtgtcatgttaggtattgctaggtactatttatattttttatgagattgatgaaaaagcaactgtggttttttgccactgaaagtaatggcatttatgccattgaaagaaatggcaggctgggcgcggtggctcacacctgtaatcccagcactttggggggccgaggtgggcagatcacctaaggtcgggagttcaagactagcatgaccaatacggagaaaccccatatgtactaaaagtacaaaattagctgggcatggtggtgcatgcctgtaatcccagccacttgggaggctgaggcaggagaatcacttgaacccaggaggcggaggttgcggtgagccaagatcatgccactgcactccagcctgggtgacaagagtgaaacttagtctaaaaaataaataaataaataaaaataatggcaaaaactgcaattgcttttgtacccacctaatattttagcaagcaagtaccttgtttaggcttggcatgtgggtctcagcctattttgtgggctggggaggaggttccaatgataatttgactattggaggcttcaagggtttacttttatctgctcagtgcctttagtgcccaaggagtctccactgctttctgctggtgctggctgagggggcagaaggatttcccaggcttggagtgcatggggttgggtgggcttggggagatgttggtgaggcgatgagggaggtcggagggaccactctttgcagtgccccgtcacctattccgcccactctaccgctgtgtctgggtggggaagagactcagtctcacacctactgggacgaagggcctccccaggtgagatcatttatatagctgcatccctcttgcaggttctgccttcttagatattttttcttcgacaaggcagccctgggaccacaaggaacatgaagacttccttggatgtttgttgttggtgtggctcttacatccattttatttgctgtggtgctgcgtagtctggtagtcagacgggtcacagttgcatctggagaaggaacgggcttgctggggtccttctgttgcctgttcaggggtggaaaacagcaagtcggagtggccttctgtttgtgatcggccacaagtcaccccatgctctgctgtttctctggtcttcggtcccaggccagcttgtctttctcctatcacattttagcagtgtcttctggtagcttcttgtgccattatcaggcctgatatttgtgttttacacagagggggaaggaaaaaaggatctgcatgtcatgaggactggcagtccatatacttttaagtagtgtgggctgcactcagtaaaggaaatctgtaaagtagcatcacgttgggctttagtcaacttttattttccccttagatctgcaagatcaagaggtttggattacatctttttcacgcagttccgcacgtgaacaatttataattcagataatgtttagtgaatttaaaatagcgattgtaaatgattgatgttaagtcacatcatcttctgtgccacctggctgtaatggatttcagcacagtaaataaagtctgccatacttgagtgaggcgtgtgcatgagtcaaagtaaatgaaatctaaagcttgttctaatttcatgttgatgccagtggggaaatgatagtaacttcagtatatgtatgaattatcttcagttttaacattgtatttaataatatgattatttattcaatgaaagcactcccttgacttatttttcagtcagcttgatttataaatcagattcctgctcttttccacctgccctggccctctgcagtggtacacatcatataaataaacatggaatctgtaactaccatgtcctgggaacccggctaggtgctgggtaggtggagaacgtgtaactcactttacttgctctcagtacctcctcaatactgtatctgaagatatgtgagagacccaagagtgcaaatatggccttccagagcttaaattccttctggtttggcttatcaaataactgagttgacttcttcctctgcccctggctgctttgcagctgccaatttgtaccagagatatttatcaacacatgtctgaaactcattactggtattttactccatcctcaagaggaatgagtctgcccaggtacccaggtgcctgaaaagatagtaccttgtctttacttatccttattaatctccagctcaccctgtgtctacccaattaaggcaagtagtcacttaaatcatacaattaagtaactctgctttctccacattctgaacaatttatgccattcgtggacattaaaggaacataaagactacaaagcagttcagttttaggcaagtttttatctgaagggcaggctttacgtttccattgtcaaattttcaactgtaatgagtatattaaaggtttagcacatctcccccttttttaaaattcaggtacatacccataaaatccaggcatctcatattgcaggtgctacattttattagtgttgtattttgacagcttcgtgacacatgcagaatttttcttcaggtctgaacaaattatttttaagtgatatacagtaaagtagaactttctgtgtgtacagatctatgactgtaaatacatgtatagatctgtgtaaccaccagcaaaatcagaacacagaacattcccttcacttcaaaatactgtagtatccctttgtgttgacaggctcccccaacttaaaccctgaactacttactgattcacattttttttttttttttttttgaggcggagtttcgctctgttgctcagggtgcagtgacacggtcttggctcactgcgacctctgcttcccaggttcaagccattcccttgcctcagcctcccaagtagctgggattacagatgtctgccaccaagcctggctaatgttcatatttttagtagagatggagtttgatcatgttggccaggctggtctcgaactcctgacctcaagtaatctgcccgccttggcctcaaaaaagtgctggcattacaggagtaagccaccaagcctggctgattcattatttatccttgtaattttggggtgtgagaatgtcacaccaatggatgtatgttctgtgtaacctttgagattgcaagcggaaaagccaagtggtaccgccattctggaagataggttggtagtttcatatgatagtaaatatacatcaatcatatggcccagaaatccacctcctaagtatttaccctagaaaaattttataccatgtgaatgtttatagtaactctattcataattgccaaaatagaaacattgtgaatattctttgacagggaattggaaaaacacatgtatatttttataagagaactaaaatcattactcccaaaaacaaactactgatacacacaacaacatgggaatttcagtgggttatgttgatgaaagatttcagagtcagagataggtgttatccatctcttgttttgtttttgcatttgtattttggttgagccaaggcctcgctatgttgcgcaggctagtcttgaactcctggactcaaatagtcttcccacctcagcctccgaaagtgctgggattacaggcatgagccatcacctccagcccttaacacatgtatttcacgtagattagaatagaactattgaaccatttagcaaggtgcaaagggaagatttgatcagagatgaaattgttcttgtctacacagtaaaatgacaagtaaccaaaacatcataaagttactgtatcttatggttgtcattaagctttcaagaacactgacacatttgcattggaaagagtttagttacactctcaaagagttaaaggtactcacaaagtgccctagttgtaaggcaggaacaaatacataatcacatatcatttccttcattttgggttaaccgcttcacatacttgaaattggagaaataatcactgttgatttcagttcaacatcgatactgactgcaaccagacatatcaatgtgagacagcagtatcttcactgaaatctgtgcaaaagatcacagaattttaggtctgaagagttccttcaggttggattaatacaattctcttgtttcatagatgaggaacctggaatacagataaaatgatttagctaaaatcacacgtgaattaatgacagagccatcacagaactccaaatgttaagcccttggtatgctgcctaacataacactaagatttacatcattatttggaaatattcctataaaatttaaacatgtagctgtataatgaatacagtgtaggttaatttatatttttatttattgatttattttaaaaatgtttatgttatttactagagactagggataaagtggccaagagacataaaattgcacccagagagctcagaatttgaaagaaggtggaggttgaagcagttttctgtgaaactgaattgcgtgaaggattctgtgatgacctagaggcaaaaatcctaatctggcttcaagaggctaagaaatgcccagcgagaatcctcagagtcttcaaagactcttagcttagcaggaagagttgacagtccatacaaggatttcagggtttgcaaagccctgggaacggagaaatgccatcattctggagaatggggaaaaataaatatggctggagctgaacacgcctgggagatgacagagttttacactgcagggcttgggggcaaaaaaggcaggcagctacaatatgatggcttatttctccaaaataaaattatattttcctctatcaaaaatagatttatttagtgtttcattaggataacattatttttaagtttaaatcagaacaatatgtactatagagtcaacttggggaaaaattgagctgtgttaaagaaagcaagactagttgtgtaactatatgttttgatgaatgttaaagtatagtaagttcccacttaacatcattaataggtctttggaaactgtgacttcaagtaaaactctgtataccaaaaccaatttccccttaggctaattgatataaacaagagttaagttcctaagcatatttctgctcacaaaaagcaagaccaaacttctgcataaagaccaaaacactcctaatattaaacatttaagtaaatgtgaactatacacacttttaagaaagattaatgaagacaagaaagattactgtttaccaaatttttggtggatggatgagtgacattcataggggtgcaggttggttacatcaagggataaataaatgtttgtttgccaagaaaacattgtcaggaaaacctcttcccccgagagaggtcaaaaacatttacacatgtgacagctccctgagcactttgctattgcattgtttattgtcctgcatttgtatgattatcatatacttgaaacatttttatttgacgatttatattcattcattcattccttttccaaccagctcattagctaatgccaataaacctcacatgcacagctttgggatgtgggagaaaacctgggagcaagtccaggcagacatggggagcatgccaacctgattgatatgacttggctctgtgtccccactcaaatctcatctctaattgtaatctctataatccccatgtgttgagggaggtgtttggatcatgggggcagtttcccccatgctgttctcataatggtgaaggagtttttactagatctgatggttttatgtttgacatttcctccctcacatgctctctcctcctgccatgtaagacgtgccttgcttccctttcaccctctaccatgattgtaagtttcctgaggcctcccaagccatgtggaaatacgagtcagttaaatctcctttctttataaattacccagtctctaggtcttggataatatcttcatagcagtgtgagagtagactgatacacccatacagacaccacccctgctaggaatctatcttcttcatcattgttataatgaaatgacattcaacaaaatgacttcatttgagcacctactgtatttaatcaaagccagtatctattttatttttcaggtattattattttgaaaatcctgtttcaaacagataaccagttgcaaagggcaacaatattgcttgcttctttgttttaaagaaataatatctcagtgttagcaagccaaaatagttctaaaaaccagaaagaggaacaaaagttcttttgttttaaataattataaaataacataaaaatttaaaaataaaaagtgcttttactgtatgaaatttttgtaagttaatcagctttaaaataactataataagctgtaattacagttcttctcataaatataactgtcacatagcaggcttaaattccaaaatgagtaataaacataaacctgatttgacatttgattgaagaactttgtgtggaatatggcagtgtgcttgctgactgtttcatgcaaatgaacaaagtaatataagattaaattaaagcaaagttcagtatagaacttaagaaattaaatatatcgactgagaggtatgtctaaagtagttgaatagacagtataagtcttttcaatgtgtaagaattttttacatgacaattacgtttttagtaagttaaaatcaagtcgaatgtctaggggagatgaaatgccagaaccaggagacagagttaggagcctactttggtggggtgggtgtgagataatcagtgttcagctgagaggttggaaatggggagaaaacagtggtgtgaaaaacatcaaagaagtacgaggaaaataaactcccccaacagttacttctagtggccgatgactggtgacatgaaaagaataaaaaaaaaacttaggagattttaagaggcaggtatttcatgttttgactgccctaaatgttttcccccttatacttatgagtaaagttatctgctgagaacagaagaaataagggctgggaatgggcttgagaaaaatgatgacgacttagggcaataacaaatggcaataggaaaaatacactgactataattcaggaaaaaaatgtggcaccatgtgtctagtgtgagtctggaaattttatatatatatatgtcagtataaatcagcaagttcttcatcatctttcttgtgcacacatacaggaagatagagagtggatggttggattgatctcaagttggagttttgtcagagatgggacagattggtagtagactttaacacagttaaggtgctggaaagacagaatagcagagtaccaatcatgttgtccaggctgggtaaaaatgtgacaaaatcattagtagaggtccccaagaattgggaagtgtgtttcagaaagtacacacttacaatagttaaaagatgttgcagtgtggtcagcaagaggggttaggtgcttaagtttgttatgataaagagtaggaaggtgcaaggtatgaccagtgatttcataccttgcaccttgatgttataccttgcagtagagtggagagaaaagttattgggttaaaagagccaagaacccttgagtcactttacaagcattatcagattgcccacagggagcaatgacaacaagccaggggctacacgaagggagaggacgatgatggacagcagtagagtcatgttgcatggtggcataagtctcaaagtgaaaggggtgtaaagtggggaacacagatgagtagggtgctgacatcacctgtaatcccaaagggagaagggaaaacactctcctcgactcgttttgcatgtgaaccaagtgccatgtgtgtattaacatgtagggaaaaactaacggctatgcccacattcttctttaactgtgtaatattaaaacagtatgtttactttcctcttccttcttctacccaaaaccatgaatttgacttaagatacatatttttcttttatatattcacttatcttagggaatgataacagaaagcaaggaaggaaggaaggaaagaagaaaggaagaaggaaggaaggaagggagggagggagggaaaggaaggaaggagagaggaagaagggagggagagagggagggaaggaaggagagaggaagaaggagggagggaaggaaggagagaggaagaaggaaggagggagggagaggagggagggatgaaggaaggaaggaacgaaggaaggaaggaatgaaggaaggaaggaaagaaggaaggaactaagccagattccaaacttgatatatagaaagccctgcaactaatacttatggaatataatttgttgtaattgcatgtggaaccaaaattgactatatttaaatcaaaactgctaatttctgacaaggactggtatctgtactacaatatatcaagagagttttcagtatttaaaaggaggaaaagagagacctctcattcaagaagacgtataaatggcaaataaacccatgagacaatgttgtacatcattacccattagttaaatgcacgtagctgttaaagtgtggaaaaatgccgacaacaccgaatgcctattgagaatacaaagaatctggggtgctcacacactgctggtgggaatgtacaaacagtctggggaaaaatttggtagtttctttaaatactcaacatgatttcacaatgcagctattgccctcttgcgcttttatctcaggtaaatgaagatttatgctcacacagaaacctgcacacacatattcaaagcagctttaggtgtcatctgccaaaactagtatcagtccaaataccctttaccaggtggttaattaagcaagctgtggtatatccacaacatgacatactacccagcgataaaagggaacaaactattggtataaacaacaactgggataaatcttccaggaattaagctaagtaaaatccaatcccaggttgttaaacactgtgatttcatttgtatgatttttttaaataaataatttagagatggatactgattagtggttgccaggggttagggacagtgaagggggtgtagcaagaggggcatgagtgtgattttaagggaagagcaccagagaatttggaaggaatggagctgccctgcattgactatggcggtggattcaggagccgagacatgtgacgtatttgtgcagagctacatgcacaaatgtacatacaaaatacgaataaaacagggaaagttttaacgaggctggtaggttgtatccatgtcaatgtcctgattgttatagttttgcaagatgttaccactcggggaaactaggtaaataatacatgtaatctctttatattattttgtactacctaccacatgtgtatccacaattatcttaataaaaatttcaagaatttagaaatgttaatcatcccctacttgtgtttatacactataaattctatgtagaaattgaagtaaatgaaacaatactacaaacaataacatgaatacatttcaccaaaatcatgttgaacaaaatgttatatatagtatgatttcatttacaaaaaaactttaaagaagatgtaaaactgatagtttggcaagatgggaggagaggatggtgactgggagaaggtacaagaaggctttggggtgttggtaattgtctaagtgttgatctgtgtggcggttcactttgtaaaaattcatagagttagacattcacgatctgtgcgctttttggcttgttacacttcaataaatgtatgaataagaaagaaagaaaaaaatctctcttcaaacaagccaacaaaacaagcaaatgaaaaagaacaatgttgccaacgaagacaaatcttcagaaagaaatacatatttagttaaccacacagcattcacagaaatagtttcctcttttcaatttgtgtgtaacattgcatgagttacttcacatataatgacagttgttcttcttcctttgaagaatccggtgctctgtactgcctaaggtgaggatgtagggttgatagacagatgatatgattgatggggcaaatcatatgctcatattcctgaaactactttgctgaaagtcaagcttcctatttgattagggacatttgttttggttgaattgattttcttcttacactttttctatttcaacatgcttttctgtcagcatgttgagttcaatcaatggatttagtgtttcttttcactggctgacagcagcccctatgtgactgttttgttaatgcacaatgaatgcttcattgaaactcacatttggtgtgacccagacattaatatgcggggggagtgttcaataaatgctgccaaatctatttcagctatgcatgttgttcttttcaaaattctcttaatgtataattacctataatatattttaaaaggagagtttgtgataaagttacatactagttctagacaatgaaaaccttttgtgaatgaacccatacaatttgttgtgatagagatgctttgtctttcatggctggtgttgtgcaatcctacagcaactgtgcacatctctagtcacctcacatgaacaactgtgccatattttttccaggactgtcccagttgtaacattgtaattcctgcacctggggaagcctctcggttccaggaaaatgggatggttgattgccctaaattgattttttaaaagaaaattcacgaattggcagccatagaatagagtaatttctgtaaagcaccagtgatagtgatgtttgaatattaatataatggaccagaggctgtacagtctttgaaagagggtcttgctacctatatatctagggtttggctgtttaaagcagcaagaccctcctttcaggtggaagtcgatgtacttgttgccttacctaaaagctttgacatttctctttcttgcaggctcacgggatccagtgttcctgacctcattgtgagcatgagcaaccagatgtggctacatctgcagtcggatgatagcattggctcacctgggtttaaagctgtttaccaaggtatgatgagattacacttcacagggttggaagttagcattccaagagagggcagagagcattctgtgttggttaggtagaagtaaaatcaacaagtcaaacaatgctgataaataggaatcatgacgggaacttccttaaagtctactaacactcgctttcgtgaatgagaatgtttaacttctgaaaactcggcttgccatgatatgtgctctgattatcccaaaataaagagtgaggtgaagtattaggtgtaagctaggaagtgtgggcatatgtggggatcttttgaccatatcatattggctggtgtctctgaaaaccttcttttatgtgagcaaacatagaaaagacaatatagtgaatctgaaaatacttacaattataaatttttatgagccaaattcaaatatttgaaatgaaagccctgtgcctgtcattgtttttgagctagtttacaactttacaagttatagaaaactgatagcaatgcaaacaatttctgaaccattgaaatgcaaatgaatttcctgtgaaaaagatcccattaattattgtcctgtggatattgattacttttaaatggattagcaagtttatttcagtatttctgattgtctatatagttgtgatctttggattctcctttgaaatagtttttaaaatatcttattggttccttcattggtaactgagttccttaaagtatttgaaccgatagatgtgtatgtgtttaggtaaaaatgagaatatttatctggagctgttggaactgtattttattctactttttgaatttgagtaaataggcagtatgttcttatttcccaagtgtataccataggaatagttttaggagctgaaaaatgtaacaagaagttattacccatgaaatcaatgaaggagataataaaaaagcatccaccaatcctaaatcaacaagcatggtaagggacattgtcatgagtccatgtgagtgaacacgccacaccttggctgctctctctctctgtgtgggataaagggtcacaatattaaagggtctcttggtgtgtgggcccaccccggagtatcctcatctacaaagcataaaatagggtccctccttgctgacacacggggtgtgttggggacttaatgacccttgtgaataagaaatactacgacaaaaaatgtatatttacatccctttcaatgactaaaactagaatgcagaggcaactgctgaatacctcctgacgtttgaatttttagacctgaccttcaattgaacttttatgtgactgtgcagttattcaggaaagtatggtggagatatcatattttccacatgacctgcatttgctgctgcctttggtagaatctgaaatcatcagtgaaataccagacacttcccaacagggcaaattgcagtaaattcatctcagcagcattgagatacacatcatgaggtttatggtaccaggaataggagaggaacctcgtgcccaaactgcatccttgactatgaagagacataagtagtcccaataaaaggtaaacattcttctatgtgtcatatttcacagtgaatgaccacaccacattaattataattacattttaccctaattagtgctgtggtaagagtctcagtagccaccctgagatggcttttcatgagatgtcataaaaacgtgaatggccatcagtccttgagagatggccaattcaatgtcatgtgttatctttgacaaaagaatagtccaaaggcaaaaaggtaattaaaaccattaaccaatacaacatttgaggattttaaaaaattaagagattataacagtagaagacattctaaaaatgcatatttccagagtactatattaagctaacagttgaagacaaagtgcaaatcacttataaaagtgacctttatgcgtatacataattttatattatttgactcaaagcaaagttattcataaattatattatcagaaaacagcccgggcaggggggctgacacctttaatcatagtgctttgggagaccaaggcaggcggatcacttaaggtcaggagttccagaccagcctggccaacatggtgaaacccctatctctcctcagaatacaaaaaaaaaaaaaaaaaaaaaattagctgattgtggagggtgggtacctgtaatcccagatacacaggaggctggggcagaagaatcgcttgaacccgggtagtggagcttgcagtgagccaagatcgtgccactgcactccagcctaggcaacagagtgagactccatcttaaaaaaagaaaaaaaaattatcagaaaatatatacagcatatattcacatagagttaaatgttctacgttttgatgttgcctgattttcactaacatctagtgttaggaacacaggctctggagctgtactcccctgaatactggttctgctgcccagtaactgaaccttagtgtaagttatttaaaccctttgtgtatcagactcgtcattaaaaaaaaaagtcctagtaatcacaactgcttcataattttattgaaaaatcaactgagtaaaacatgtaaggctcataacacatggagtaagaacttaagaaatgcgagctcttatttctgtttgcattttcattttaattttgagattttttctacaaacatgatgttttcattatataaataatagtgtgcacagtaagacatgtaaacccaactgaggggtgtttagatgaattgtaagcaccccttctctccagcttctagctgagccagttaacttcctctgaggcaacagctctcgacattttctcatagtttccccagaaattttcagtgtgtgccctctcatacctggagtcacagtcagtccctcagactacaaaccctagacaaactgctatgcaagaaatgccacatcatcttattttaacatcgacttgaatttctgagactccatcctaagaaagtagctatcattgtaacctcactcattaccaaaggccacccatgtcaacccttactgacctacctactccaaccttgacaagaaatcaggaatagcctgagtagtgtaaaatatttcggggaccctcaaatcttcggatcacacttctaaccctaagatgttcacggtctctgctaccttgggcactgttgtctctgagaaaatctccctggaggatgctttcctggcacccccactaccccctgccagcacacacagtaatggtgagggggctgcctcaggacacgtggaccaggaggaccttgggtccactctacccacctgtggcctccatcattcccgggctcgtaggcttgggcatatgtgagatttctccatttgtgctgtctctaactccccaaagacaatcctctctcctccatcccctcaagatgcctggagggtctactcagttaatggacccttttaggagcatttttcagaaagcaagtagggtggagaaatgaaaaccagggcctgtgcatcccctgaaaatcacagtgagtggaggataggcagggaggagctcagagactgaaaaacaacagggatccctgctggtgaggccccagcagcaaacacagaagaacaattcacagaaacaaacgctcttgctagacttcagttggcatgtgtatgttatacagtatgtgttatacatattccctagtatataagcctgttcatacttatgagcatgtgtattatctatagctattatacacagaacgagagagagagagtgtgaattgataatttcccctaagcaaattatggggaaaaaaatgcaaagtttaaaaaacaaagagagctcttgagggagatcatgttaagtgtcagaaagtaatgggagagaggtaagctttgtttaaaaccattttacaaatgaaaatactgaattaaaaataatctgttcaaaagcccaaatgctaagaagcaggatgtaaattaattatgatagagccatataaagcaacactgaccattcataagcaaactctatatgactagtatatatttttaaaacaaattttacatatacaatttatatataaatttgctatatatatagattctacctatatataattgtataatttatatacttaaaaatcatttatttatatatttataaatcatatttataatagatagaatccatataaatagtaaatctcagaatactatataagaaaagataatgtgagtccggggcatagtttctccattttatatttgaaaataaaatatatatctcatagcaactgattgttagtccacagaaaataaagaaaaatccctatgctcaattgaaagttgggttccctcataaccactgcagcttctagccatgaggaagttaacaagaagcaaacttgatccctggatatttttataagcaattacatgtttgctattgtagtggtcccacgtttttatggcttctctgtctatagtaaagtgagttgactctgaagcatttttggttacaaaaaaaaattcggttcgagttcatcacactagttgatgaactgcatctccagaaatcatgtttcatgtaatttgccgtagctatttacattccagcagggggtgaattaaaggaactgtttcctgtgatgtgctgctgtatagtcaaaacaagacctattttgggctaatactaagagtgattccagtaaaattatttgacttcagcatcaccatttcatacaagaaacggaattgtctccttcgtccgatgaatacagtgataataagagaatggaaatttgtgtaggcatctcagtctgtggccaagggtctgtgctcctagggtgtatgggggaagtgaggctgtgtgttgtactgaatacaggaatgtaggagatggttcaaaaaccagcatctttaccattcttggcagacggaacttttgagacagcattgatgttatgtaatcttgaaggtgcttctcgtcttgcgtggttgtactggcatgagttacccagcccagtctcgcccgtcttctctaggtgagcaattatgcacattgaacagcgtccaagtgcaatgacggcacagggtgctgtccctgaaccgaggacagctcactggtccttgtagaaagtgagctcatgcccctgtccttgtgagcatgaagccaatacgctattcatagtcagacaagacagtgcctgccagaatagtagtgacttctaaaaccctaaagagaaggtgaagctgcaggacgtggcttcaaataaccttttgtttacatgttgtgggaatgctcagttgactgtcacaaagcgtttataatgtgtacctcctttttcacagcacatacagccttatatctaaggtggatttaacatttttttccaagggcttgacttaagtctatgacaaattatcctttttcttggaagcagagcctgagttggtgacttgtgtagcaggaggtattgggagtgtgcttggaatcgtctgtaaggcagagaaggaagtggagttgggtggagggagaggttgaacagtgcccagtcacgacaggtgcacagttagttcattcaggttgccgtaacagaatatggagatagagttggcttggcgacaatggaattgtatctctcacagttctgggaagtccacgatcaaggcagtggcagatttggtgtctggtgaggaccgtttcctggttcatagatggcgccttctcactgtgtcctcacgtggtggacagcgcaaggccacaagcctggacatccttcacaagggcactaatcctgttcacaggggctccaccctcatcatgtcatcacgctctaaaggctggcccatctctgaaaaccatcaaatttgaggttaggtttcaacttaggaatttggagggacacaaacagtcagaccacatcaggttcttagataagagtccccagcctttttggcacaagggaccggttttaaggtagacagtttttccatggactgggagaggtgatgatttcagggtgactgaagtgcattgcatttactgtgcactttatttctattattacaatgtaatgtgtaataaaataattatacaactctccataatgtagaatcattgggagccctgagcttgttttcctgcaactagacagtcccatctgggtgatgggagacagtgacagatcatcaggtattagattctcataaagggcatgcagcctagatccctcgcatgtgcagttcacaatagggttcacactcctaggagaatgtaatgttgctgctgatctgctgggaggcagagctcaggtggtaatgctccgttgcctgctgctcacctcctgctgtgtggcccagttcctagcaggccatggacgagtactggtccctggcctgggggttgggaacccttgccttaaatgatgctacagggaggtctggagctaggatggcactgtatagtcttccaaactgaagcaattgggccaggcttggtgccattgaccattgacatgggtggcccccagggagggaccagaacactgcttgggatgattcctgaaaagaaatgcagtgtgggtcccgagcagctgggaggtgggggggggggcctggattctgaagagagcacccaaatggtgcccttgggatcaaatacagcccagcactagcactggtcagtattctccatctggaaacagcttctctaggattctgactggcctcgtttcctaggaacacgtgtaacacacactcacctcaccgccaccctcctgtccggcccatgtgaggatctgcctccttagctggcctctcagctgggctagttggcttctgcagcagggcgatgctgacccaagtcctcacagggcctcggtctctgctcacagtgcactgctcaggtgtggctgctagacttgtccgtgttctatcacacgtaagagagtccccatggataaatcgtcccactcatctgtattgtctcattggggacaatggccccagctttttctcctgattagggccagtcctcctgcaaggatgatggctgcttccattactggtgaggccttgggcatgaggatctggaagatgctgggccacagggatagcttacagtttcatggggcccttcctcttcctgctgatggagacagctcccctctgagaagcaggttctctacaaccacattgcctaatttgagagatcggggagcagagatctcaatcagctcctggggtggaggtgagacagctactcctgcttcccctcctcagttcctggccccatgtattccagcctctggggactgacacagcattatggccgtggatttagggtgaagaccacatccagaggacagcagcacatccttcccagcatactctccaagctggctcctcagccatgccttcagaagcgcattccctcattctatccagcaaaagccttctggacttgcagtctgtggcaggaatgccaggtctcggggtcagtagcccttgcatcttcttctttattctaaattaaggcctttgtttgagcacttccctgagaggtgtgcagctatgagccctctctagcagcctcagttccgcagagcgatgagggccgcatctgatggtgggacctgagtctgcggtgaggcccatgcaagggaaagagtcgtgtcacatgaactcatgtgctgtaaattcaaatatcctctcaacgggctttcctgaggactgccattccatttaatatgctaaagaacaaacttattgttactgccctccacatcccttgaaacaaaactagcccttctattcttgggaccacaagtggtcatgtctgccttcctggtgcttagctctttgcttctagaacaagcttcctgacctgggactcacatcacagcattgtctgttcttacccagagtgcggcatcattgtctagcagccggggaaaataatctccctatattctttgagaatttggacaacagatttataattattgtttttgtgttatttcttcttagcgacattggtggtttatgatcctgttctctttttctccacgaatttcggtcagttccgtctagtaaatatccttctatcccatccctcctgtttatcttcattctcttacccttagtcggcttccacagtgtcccctctaggcggcctctgtagtggtcgaaacttcatttctccccgctactaaactcttctattttgctcacacacaggggtccagtcagaattatcttttttaaaaaaatgaacatagagagtgttcctacactgtttcaaattggttggagccttcccagggtccacagaatattctgtaaagtggtttccagattccatcttcatctctcaccaccactcacatacacttgatgtttgtcccatggaacttcctgatcttcaaatcttccttttttcctctcttttacctttgcacacgtatctccccaacaaggatcattcttctatggactcaccatgtagatcatttgctgatcttcccgtctcatctcagagtttactttccccaataagcctcacatcctagattatgtgatttgctgctacacaatcctataccaccctgagctgcctccatcccaacaattgtttaattgcctttcttcccaggagacagaagctctgggaatgcaaggacctctttatgccccacacctgtgcagctgtgcagaagctgcaggttgtatagctgcatccttagagatgtgcaaaatgtgagtgagtgtcttagccagtttctggactgtttagatttttgtagcattatcatgggccatttaacccttatcaataatcttaggaccactccagtttttttttaagtcttagttgagtttttatacgtttgaggaattatagcccagtagccaatgagtcaacacagactgtttctggttgttgatgctgctctgattcctggacccaaatctgttcatgtgccggcagcctcattcttgagtgcttgggtccctgaatgatgacctttcggaacccaattcctgaagtatatccggtgccctctctggttctctgagtccacctcccctggaccgtccgggagttacccttcagtggtgggtgctctgctgctattggttgaattcccctgttggcaaagggatgcatttctgcacagatctcccatgtacctgcatttatcatgttctctgctctcatccgtgtctccgactgccgcatgcgtggagatcacccaggggtcttcatagacggagattcaggtcagggtgggcttaaaagtgcatattcctgtggcactggtgctgcattgcaaggaagttgtatgagaaggatccaccgtgcgattcccgtcatattacggccgctgtgttgtgtaccctgtgccccacgtcagccagcagggtgagggacacaccggcctgtctctcctcgcctcaccctgctcactctggtccatgagtcagcctcttcgtgcacctgtggctcccgtgtgccccaccacggtgcagccaccacagagcaagtcactgaatttctgcccctcttccagatcacgtgtcctctcaagagccacagggtgctgtagcacagtgtagcatgctgtgtgcttgccatcctgtgcccatccatcgttctcccccacactggcgctcatgccgcttcccttctctccgggcgggtccttcctacccttgcgggtaggaaacaacccttcccttccccaaggcccagcttgagagctgcacctctctcctggacagctcactgggatggaaattccttccaatgtttccctgtggctaccagcagcagctcctttttagctaaggtaacagttttcctagagtgttttgtgtgtcctcgagtccttgagaaagagccccattttattcaatcctgtttctccagaccattgcagagcacacaatgtcttcatcttggtgagccatttagtaaccaaagatattaagagccatttacaaaccaaatatattaataattaagtgtttgaagctgaaattaatagattatatgtgttcattgttgctattgttttctttaggtgaattaccagctaggccaactagcgttccgttgtcttaacgcaagacgaataagatgaacataggattttactgaaacgatattaaaacaaacaagtaataacaacaaactatatattagaaagatattgagtttccagtcatcacccttttttgttgacagggttggagagtttgtatgaagatatgctgacattcaggacagtcttaactttaagaaaaatatcagaagacccattgactcttgatttccatttttttctgagttatattgcatgaatgaattataagcacagattcctcttaataatgtgagataagccattattaaatatttaaatatatcagcacatatgagccaggagagcaggtggtgccggagaacattaaattctaacgcagaaatttgacatttaaattccagtgttagtggcccgttagctccagctacattgcactctcccttcccaacatgtatcctcacagattacatgtcaaagtaaactgagataagatgtagtggaaatgacacggaggttaagcgctgcggggctcacgttagagcaaacttcctgggagacgttctccaatctgtattttagtctcaggtaagaatgaaagttctgataatgatatttgcgaattatgaaagagcttgtgaaattaacaaggtgtacttctaggtgatattttaggctctgtaattggaatgagcttcctatttttttccagccatatggctgccttcctcatttctcatgtgttccatgagtgtgtgaatgtgataacattctcccacatctttaccactgggatccctgcatcggatacaacaaggacccacttttacaaacaggttttttcctttcaattggaatttgttgctttcaattttctcattacctttattatttttctttggtatttctgtttcctttacgagtttttatgatctcaacaagagtctttgttaaaatttctgaattgtgttgtcttagaaatggatgatattttgcattactgatttaaaagttatagatgggactattctattcttgaaattcatcctgtgttttttaaaccgcgtacatatcctcttgcctctaagccaggaacggccaggcgtggcatgcggttttgatgactcagctccaatgcgtttcttttagatcacctcttgctttaacatgtgagcatgtggagctccgtttcttctgcttttctcttgggaaagggagtgagcagaaagaaagtttgtgccatctgagactgagaatgagagaaactgaagaagttaggcagcttcagactttggcaaaaaggttgtgatgtgagctgaaggtcagggagtgtaggatgaggggtgaagatgaggggtacagggcaagggaaacaggttcacgagtccaggatgagaggtgcagtgaggagggcaggatgagggggtccaggttaggagtccacgatgaggagtccaggaagagaggtacaggatgaggtgttcagtgacgagtacgggaggagaggcctgggtgagggattcagagggaggggtccaggaagagaggtgcagaatgagggatacaggtgaggagtacagaatgaggggtacaggtgaaggggtccaggatgagatgtgcaagggaaggagtacaaaatgaggggctatgggatgaggaagtgcaggatgagggtgtgtagggtgagacagtgcagcaggagggctccagcatgaagtgtagaatacaaggggggcaggatagtgcagtgctagagcttagccaagagacctgggctcgggtttcagttctgcatccagtttgttctgaatacccctggcctttagtagcctcatctataatgggcaatggggatgggtcatctgcaggctttcctcccacttctgaaagagagaaatcaacagctccaaatatttcgtctttatgggaagctcattcctggaatgattagcaagctgaagatgtgattgccacctctgatactgaaacacgtccactaggactatttcaatgctaaataggataggagagaacgcaactaggttttggcatagtaggaagtaatgcaatgatgctaagtgaaaaactgcgccaacttagataaccacaaagcacatggtgacatcattcacaaggccttcagtgttatgcattttctaaattgtattagaaaataggagagtaaggggtggagccaagatggccaaagaggaacagctccagtctacagctcccagcgtgagggatgcagaaggtgggtgatttctgcatttctaactgaggtacctcgttcatgtcactggggagtgtcggacagtgggtgcagcacacaaagcatgagctgaagcagggcaaggcatcgccccacctatgaagagcaagcggtcagggaattccctttcctagtcaaagaaaggggtgacagacggcacctggaaaattgggtcactcccaccctaatactgtgcttttctaaaggtcttagcaaatggcacaccaggagattatatcctgcacctggctttgagggtcctacgcccatgaaggcttgctcattgctgagacagcagtctcagatcaaatagcaaggcggcggcgaggctgggggaggggcacccaccattgcccaggcttgagtaggtaaacaaagcagcccggaagctcgaactgggtggagcccacctcagctcaaggaggcctgcctgcctctgtagactccacctctgggggcagggcatagccaaacaaaagacagcagaaacctctgcagacttaaatgtccctgtctgacatctttgaagagagtagtggttctcccagcatgcagcttgagatctgagaacagacagactgcctcctcaagtgggtccctgacccctgagtagcgtaactgggacgcatccccagtaggggcagtctgacacctcagatggccaggtactcctctgagacaaaatttccagaggaaggatcaggcagcagcatttgctgttcagcaatatccactgttctgcagcctctgctgctgatacccaggcacacaaggtctggagtggacctccagcaaattccaacagacctgcagctgagggtcctgactgttagaaggaaaactaacaaacagaaaggacatccacaccaaaaccccatctgtacatcaccatcatcaaagaccaaaggaagataaaaccacaaagatggggaaaaaacagagcagaaaaactggagactctaaaaatcagagtgcctctcctcctccaaaggaaagcagctcctcaccagcaatggagcaacgttggacagagaatgactttgatgagttgagagaagaaggcttcagatgatcacactactccgagctaaaggaggaagtttgaacccatggcaaagaagttaaaaaccttgaaaaaaaattagacgactggctaactagaataaccaatgcagagaagtccttaaaggacctaatggaactgaaaaccatggcaggagaactacctgatgaatgcacaagcctcagtagccgattcgatcgatagaaagaaagggtatcagtgatggaagatcaaatgaatgaaatgaagcgagaggagaagtttagagaaaaaagaataaaaagaaacaaacaaagcctccaagaaatatgggactatgtgaaaagaccaaatctacatctgattggtgtacctgaaagtgacggggagaatggaaccaagttggaaaacactctgcaggatgttatccaggagaacttccccaatctagccaggcaggccaacattcaaattcaggaaatacagagaatgccacaaagatactcctcgagaagagcaactcaaagacacataattgtcagattcagcaaagtagagatgaagaaaaaatttaaagggcaggcagagagaaaggtcgggttacccacaaggggaagcccatcagactaacagctgatctctccgcagaaactctacaagccagaagagagtgggggccaatattcaacattcctaaagaaaacaagtttcagtccagaatttcatatccagccaaactaagtttcttaagtgaaggagaaataaaatcctttacagacaagcaaatgctgagagattctgtcaccaccagtcctgccctaaaagagctcctgaaggaagcacaaaacatggaaaggaacaaccggtaccagccactgcaaaaacatgccaaattgtgaagaccattgatgctaggaagaaactgcctcaactaacaagcaaaataaccagctaacatcataataactgaatcaaattcacacataacaatattaaccttaaatgtaaatgggccaaatgctccaattaaaagacacagactggcaaattggataaagagtcaagacccatcagtgtgctatattcaggagacccatctaacgtgcagagacacacataggctcaaaataaagaggtggagaaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagagtcccacacaataataatgggagactttaacaccctactgtcaacatcagacatttcaacaagacagaaagttaacaaggatatccaggaattgaagtcagctctgcaccaagcagatctaatagacatctacagaactatcccccccaaatcaatagaatatatattcttttcagcaccataccacacctattccaaaattgaccacatagttgtaagtaaagctctcctcagcaaatgtaaaagtacagaaattataacaaactgtctctcagaccacagtgcaataaaactacaattcaggattaagaaagtctctcaaaactactcagttacatggaaactgaacaacctgctcctcaatgactacttggtacataacgaaatgaaggtagaaataaagatgttctttgaaaccaatgagaacaaagacacaacataccagaatctctgggacacattcaaagcagtgtgtagagggaaatttatagcactaaatgcccacaagagaaagcaggcaagatctaaaattgacatcctaacatcacaattaaaaaaaccagagaagcaagagcaaacacattcaaaagccagcagaaggtgagaaataactaagatcagagcagaagtgaacgaaatagagacacaaaaaacccttcaaaaaaaatgaatccaggagctggttttttgaaaagatcaacaaaattgatagactgctagcaagactataaagaagaaaagagaaaagaatcaaatagaagcaataaaaaatgaaggggatatcaccaccaatcccatggaaatacaaactaccatcagagaatactataaccacctctatgcaaaagaactagaaaatctagaagaaatggataaattcctcgacacatacactctcccaagactaaaccaggaagaagttgaatctctgaatagaccaataacaggctctgaaatagaggcaataattaatagcttaccaaccaaaaaaagtccagaaacggatggattcacagccgaattctaccagagatacaaggaggagctggtaccattccttctgaaactattccaatcaatagaaaaagagggaatcctccctaactcattttatgaggccaacatcatcctgataccaaagcctggcagagacacaacaaaaaaagagaattttagaccaatatccctgatgaacatcgatgcaaaaatcctcaataaaatactggcacaccaaatcaagaagcacatcaaaaaccttatccaccatgatcaagtgggtttcatccctgggatgcaaggctgattcaacatacccaaatcaattaacataatccagcatataaacagaaccaatgacaaaaaccacatgattatctcaatagatgcagaaaaggcctttgacaaaattcaacaacacttcatgctaaaaactctcagtaaattaggtattgatgggatgtatgtcaaaataataaaacctatctatgacaaacccacagccaatatcatactgaaggggcaaaaactggaagcattccctttcaaaactggcacaagacaggagtgccctctctcaccactgctattcaacatagagttggatgttctggccagggcaatcaggcaggagaaggaaataaagggtattcaattaggaaaagaggaagtcaaattgtccctttttccagatgacatgattgtatatttagaaaaccccattgtctcagcccaaaatctccttaagctgataagcaactttagcaaagtctcaggatacaaaatcagtgtgcaaaaatcacaagcattcttataaaacaataacagacaaacagagagccaaatcatgagtgaactcccattcacaattgcttcaaagagaataaaatacctaggaatccaacttacaagggatgtgaaggacctcttcgaggagaactacaaaccactgctcaatgaaataaaagaggagacaaacaaatggaagaacattccatgttcatgggtaggaagaatcaatgtcgtgaaaatggccatactgcccaaggtaatttatagattcaatgccatccccatcaagctaccaatgactttcttcacgtaattggaaaaaactactttaaagttcatatggaaccaaaaaagagcccgcatcgacaagtcaatcctaagccaaaagaacaaagctggaggcgtcatgctacctgacttcaaactatattacaaggctaccgtaaccaaaacagcatggtactggttccaaaacagagatatagaccaatggaacagaacagagccctcagaaataatgccatatatctacaagtatctgctctttgacaaacctgacaaaaacaggaaatggggaaaggattccctatttaataaatggtgctgggaaaactggctagctatatgtagaaagacgaaactgaatcccttccttacaccttatacaaaaattaattcaagatgaattggacacttaaatgttagccctaaaaccataaaaaccctagaagaacacctaggcaataccattcaggacatagccatgggcaaggacttcatgtctaaaacaccaaaagcaatggcaacaaaagccaaaattgacacatgggatctaattaaactaaagagcttctgtgcagcaaaagaaactaccatcagagtgaacaggcatcctacagagtggcagaaatgttttgcaatgtactcatctgacaaagggctaatatccagaatctacaatgaactcaaacaaatttacaagaagaaaacaagcaaccccatcaaaaagtgggcgaaggatatgaacagacacttctcaaaagaagacatttatgcagccaaaagagacgtgaaaaaatgctcgtcatcactggccatcagagaaatgcaaatcaaaaccacaatgagacaccatctcacaccagttagaatggcagtcattagaaagtcaggaaacaacaggtgctggagaggatgtggtgaaataggaacacttttacactgttggtgagactgtaaactagttcaaccattgtggaagtcagtgtggcgattcctcagggatctagaactagaattaccatttgacccagccatcccattactgggtatatacccaaaggattataaatcatgctgctataaagacacatgcacacgtatgtttactgtggcactattcacaatagcaaagacttggaaccaacccaaatgtccaacaatgatagactggattaagaaaatgcggcacatatacaccatggaatactacgcagccatgaaaaatgatgagttcatgtcctttatagggacatggatgaagctggaaaccatgattctcaggaaactatcacaaagacaaaaaaaaaacaaacactgcatgttctcattgataggtgggaattgaacaatgagaacacatggacacaggaaggggaacatcacacaccagggcctgttgtggggtgtggggaggggggagggatagctttaggagatatacctaatgctaaatgacgagttaatgggtgcagcacaccaacatggcacatgtatacatatgtaacaaacctgcacgttgtgaacatgtaccctaaaactgaaagcataataaaaaaaaaaataggagaggcttgtatgcaaccatgtgtatgggtaggaagatctgaaactcctgattaggtcatgacagagaaagaccatgaagtcagttggtcaacggagatgttaaggcccatcttatcagaggctggaggccgcctgagtgtaagagacccacagtcaacgttcgtcatcgaagcaaatcctgatgtgcaggacacatacatgaaagtgaaacagtcagcaaaccagatgattttccgaatttcgtatgtgtctcaaccagggaaggagaggctcctgaggaccacatcgatgaggaggagctggtgaccctctctcccgtctggcttttccactttaaaacgcttgattatggcaagctgtgtgagtcttaagactggagcaatagtttttcttaaatgtcctaatgtttaaatgtctgaaataattagaaactttacaacgtgaggcttaaaactttacatgaatttatatggatataaatgttgctctcggctaggtgcagtggctcatgcctgtaatgctggcactttgggaggccaaggtgggaggatcacctgaggtcaagagtttgagacaggcctgaccaacatggtgaaaccctgtctctactaaaaatacaaaaattagccaggcatggttgcagtcacctgtaatctcagctacttgggaggctgaggcaggagtattgcttgaacccaagaggcagagtttgcagtgagccaatattgtgccattgcactccagcctgggcaacaagagagaaactccatcttaaaaaaaaaaaaaattgctgtcatgagaggtatgttcattttgttcttcaccacagagaaaatatagcataagaaaaaattcactttccgagtccaggacatccttaggcatggtgggagcctggggtttcctctgacttggcaaagccaacccatgagacattgtcacataacagaggggtagagaaaacaagattatattgagtttgtgctgatttggattcacatttttaaaagcaaagaagctgagtttagtctctcagatatttttcagaataagcctgtttaattttaacttccctctacaattcttcaggtttatgctattttgatgcaaataatttaagaactgattccccccaccaactaatttcaagacgcaaactcaaagattaagtgtattacaagtgctttgcatgttgctttgtgctgtgtagaactcatggattggaagacaggcaacaagttttcatgtgatcctttcccatttcctttgaagtaaacttttctgcctcctactaatacgtgtttgatttctgtttatatgtgattgtttacatccattgcgattggctgtcaccttctttcctacatttactcttgggggaaggtggctcattcatacatagggaggtgcttcttctggaatagaattatgcctgcgtaagttttccaaaattagtggagagtggagacaattatccatgaagttgtgtcatttagacatataactgagaataagtcactcactattgcctgaagtgtctaaagcttttctctgtaatgcatccctctgtggtgtgcaggagtgagctcagcctagaggactctcgatgctgcagttcctgaaggtcatgggtcatgcccacttggcctccactcatgctgccccgctccttgccccacactctcacctttgcatggcatgtggtccttttattagtactcatggacttacagcaactcctacaaaccttcacttttctttaaaccttcattaataaacccacagcagcctctctccaagttttcagggaaaaagtcaccttttttgtacagcaagaacatctcttctttgctcctccacagtcatcttcattgctccttcttccttcccttccttccttccttccttcccttcctcctccctcctccccctcccttcctcccttcttccttcttccttcctccctccctccctcccttgctcccttccttccttccttccttcccaccagtttcagaaagatgtgtgtccctcttttgtccaaggatggtcttgagatcaatcctcttctcccttttgagagttggccccatcaggaaacacagacaggctttttatttgttctgtcttcactatctactcccccaattcaggctccctgtatccctcacttggattgacagcatcatgctaatattctcttacccttctatcttatttttaggattatatctctgttattagaaatcctgtgtatgacacaagaggcttgtttgtatccagggttaggaggtcccagtggtatcaggactctcatttcctcagctctgctttcttttcttgaggctctgtcccatgtggggtgtctgtaaatgacagagaaaatagcttccagctcctctggggttacattgctcttacagttcatggccttgaggaacgaagagtaaagacacctccgatggcctccatctcaaacccaaaaatggccccaagtggtcctgctcaattctgcaccctccatccactgccacatccaggaacacggagaacctgactggccactccaagtgacctgtccatccctgcaacagggctgaagcaaacccccaggaagtgggagcagagcccttccaaccaggagaaataaagcagcaaagaatgcacacactgctttaaaagaagccaaatgatcacatgtgcaggggctaatcctacggaacctctgacccttcctgtcgccctctgtgaacagtggttccgggtgccacctgtcccacaccagccgcacaaagtacactgcctgcacttcccattcctctgcaatatgcatcgctcttaccctaaatacttttcattttccactttatctaaaaatacctcctaaagtggtttatctttgggtaaaacctaagccatctttttttttcttcttttattcattcctttccctttttctgagactcagttactgatctccactgctaaactgaattaggatttttatttcattaaaatatttaattctattgaaattgtgtcataaaaaagtgtgctgctattttctgttaatttgtgtttgatagatgcagacgcatgctggttcatcatttttctttgccatagagttcttttcatcttttcatcagtgcccgtggctctttgatcatgtctgttgtgcttttgatgttttcttaatccttttattaatgaggtactcaaaatataacaactgatgttacgctgtgttttaattttattaagaattttctgtcttcctgaaaatgaaataacatttcaccaattcctttattctttacatcttcaactcctttgttaacaagtcactatgtgtgagcagacaacatgctaattatttcctttcttcccccaactcaattagtgctttaatttctcttacaagttcttaaagttagaaaaagaaatgctaatgaaaccagctagaagtcaaaaataataacttgagcaccacccatacatatttatatttccaacaggttccatttcatcgacgtcaggattccgaagtctagataacctcatcctatgcatttttgcactttataagtaaaatagttttcaagaatggcatgtgttcctatttaccttttactttttaccagatttttttcctaactagattccccaaacagcgtttcttttgtctacacagagtgaaacctttgttaggagaatctgtttacccgtggagaggaagctgtggtttatcctgtcactacctgcactctatccttgagtttgctttttgtttctagcatgaccatgaactactcagtaattaattctctgatcatcagtttcattatctacaaagtaggaatcataactgagtttttgtcaggatacattgtattaaaacagagaggacagatcctcagttgaaagccatatttacatttgtgtattttgcaaacagtctatgtaaatttgtgacttgcctgatggaaaatgatctgaaaaggtaaagaaaactaattttacaatagcccatgcagcacacgtttccgatttctgagagtctgtccctcttccaaggactaggagtgcttcagaaagtgcattcacgatttttttctccctcatcctcttttctttttctccctggggccatggcaatttcctttcttgcagtcaattctattacaacaaacttctcaaattagtttttagtccatttcaactttactgttatctttccagactgttcaccttcttgtcaaaaatgtaattatcaatccgggcccgggacagtatttttgactttccattacattcccttctccctctgttgtgcccagaacaagcagtcatttcatcgttgcctctctgtctctctgtacaatcttctttggagtcaagatgatagatctcaattttacgcttttgctatttctataacataccatcttgaattatactctttctttcaaggatataatccctcagttgcctttgggtgttatgttttgtcttttctcaaagttttatcctcttactgtttacatggctttgttcttgttcttgtggactttattcgaataaatcagaactcctcatttgctacatggccttgtttcctctcgtcccctctagttccgacgtatttctaccttggttattacagctgtctcccaagtgaatggcctctcttctggccttctttattgtggtctgtgatgcactgattcatcatccgcactttcataagaagtctgttctattaaaaaaaaatgtgtaatgaaaagagttgtgcacattgcagctatagaggcttggttccatctgctcgagctgtgtgtttaagttgacctcactttgtaattcactttctctttctgagaactatctgcaagtaggcacagtcatatctgcctcttgagtgtttgtgaaaataagatggtaacatatatgtatacacgtcaatctgcagaatgtgataggtacccaggatatattagtacccttaccttagtgacgtccccaaaattataacttcttcttccaccagtgaaacccagagaacgtaacccagactactgaaaatggcttccttttccttcatgatgaggtgataaaagaattattaaaagtgtactgtgttatgattgtgattgtttgatgtaggttgtaagtatattagtttatatgttgctcctattttctgtttttctttttccctgttgaatttgccatagtagacattttgccgattgcatctccagagtgtttaagaaagtttctgtgacttggcactggataaagaggcttggacaggttcgagtttgagtttttctgacatgaggacttcatagctagtggtgttttctcccatcaggagacggggtgactgacgtgcactgaccagctgtgtttattgactaaatgccacaaatcgatagtattctgattctgttgcttctttttgtatttacttgctgaggttctcctataaaagaagcatattatttggttgtctggtggcaaagttgataggcaagacaggataaatgtggccttttcagtttattacattacatttatatattacattcagaataggaagttttcatagcctcctcagcctcaggcctatcaccatttccactgcatacttttgtttgggtgttaaggcagggacggtcctgtgactgtaggtttttaggagcatcattggccttgacccaccagataccagtagcatcctcaccctcagtgtgcaaataccaatgcctccagacattgccaaatgtcccaatgaggggagagaagatggtagcaaaagttctactggttgagcactactgctctacagtaatttcttttattgttttgtattgttaggaaagaactcatgaatttaaaacagtctgatgattttcaatctatggaatgtattatctttgttgatgctaaaattgtgctaattttgccttttagtgtgttcttgactcctgagtcgatgatagcttctttgccatccagtgggataaaccattccaaatttatcttgtgtaatttctgcttcaaacctgaaattagtcatccagcccagtgattcttggcttccttgaatggcaaatgatatttcaacattatgatctggacacttacaatattaatcactgcttgatttcttgttctttctgggccctttcactcgatagggagtgagtgtgtatgtgcgtgtgtgtgtgtatagaacaaagagacaagatttcatgctgatacgcctgattcacattcagcactgcaaggttttttctcatgtcttccattgtatatctgtagtcctttcctcacccagtgtccccgctctcagtaactctgataaaggtggaattagaatatctcataatttctcagttgctgtatcttacaacacagacgtgaaaaatttgaaagcaataccaacatttccatatgcatcagtagtgctgaaaacaatctaaaatggttttgcattcatgtttacacttcatgtctcccaatcaaattactgtatttcaaggtcctttaaagctgtccattgctagattcacaattagatttacttctttaaacattttagattgctttaaaataattttgttttattgtgatatacaaagatttgcatactttgatattccacagtcaactctgcaaaggtaggtataatttgaaggtctcacttctgcttccttctcttctaaactgtttcactttccccctgtaaatactaatttgtagaattgttctggttcattcttgcttttaagaaacagacgcacacatatgtagatatctctatatatagatattagatgtttgtgtcaacccgcctcccaaattgggtaagcagtaatgtgttttaggctctattttttttctatctaatgaattctggagctcattctatagtagcttgctctctttctctttctctctctctcctctttctctggctgtacagcactccacagagtagatggagaggccacagtttattcaatcagtcttccaacccatctattgatgagctctttccagttctttgctataagaaatagtctgacatgaatagccttgtgcgtgtatcctctcacatttttttgcagcagaaggtgacacgtggtgtgcagtgtacactgctcactagtggatgtctgctagaaaaggcatcataagtacaaatgcaagtccatggccttgatttgataattagtcacatatacaaactcatattcattgtaattatcattttaaacagaaatatgcaagttcctatagaaagaggacaattttaatgatttaaattaataaaaccatgtttaaagaaaaattgacagcaattctacacatactcagaaaatagatgggggaatacttcacaagtaatgtgtgaagttataatattctgaggccaaaaccaggtacagacataacaaaaaaaaaatctatgtactaatatctctcataaatatagacacaaaaattcttaatggtagcaaatagaattcaaatatatatgtacgtgtgtatgtgtgtgtatatatacatgcatatgcagtcatgcattgcttaacaacaacagggatacgttctgagatgtgttgttagatgatttcaacagtatgcaaacatcgtggagtgcacttacacaaacccagattgtatagcctgctacccacctgggatatatggtacagcctattgttcctaggctccaaacctgtacagcatgtgactgtaatactacaggcaattgtaacaagaagtaacatttgtgtatcgaacatatgtaaacatacaaaaggtacagtaaaaacactgtataagagataaaaaagtgggacatctgtataaggtacttaccatgaatagagcttgcaggatgggaagttgttctgggtgagtcagtgagtgagtgatggctgaaattgaaggcctaggacattaccatacactgctgtagacttataaacactgtgaacttaggctacagtacatttatttataaaatttatttcttcaataataaattaaccttagcttactgtaacttttttactttataaaccttttcattttttaaaattttttattgttttgctataacatttagcctaaaacacattgtacagttgcacaaaaatatttttatagtcttcttctgtaaacattttttattttaattttgtatttttttttttactttttaaaattttttgtttaaaatttttgtttaaaactaatacacaaacacacaaaacatagcttaggcctacacactgtcttccgcctccacatcttgtcccactggaaagtcttcggggcaataccacacatgaatgaagctctcatgttcagtgatctcaatgccttcttctggatacctcctgacggacctgcctaaggctgtttacagtgatttttttttaatgtaagtataaggagcatagtctaaaacagtgatggatagtatagcatagtaaatatataaagcaatgtcatagtcacttattattatcaagtgttacctgctgtgtacagttgcactgctccgctttcacatggctggcagcacagtaggtttatttacaccagcatcaccaggaacacatgcgcaatgcattgtgctatgatcaatggctactatgtcattaggtgataggaggtttttaactacattataatcttatgggaccattgtatacatgatccatcattgattgaaatgtccttacgtggtacaggattttgtgtgtgtgtgtgtatatatatatatatatatgaaattatatgccataagcaaatgaagtgttttccttgtaggaatgaaagactgttcaatatttcaaaatcaatgtcatttattaaattaacaggataaagaagaaaaatcacatgtttatatcagtcgatgcacaaaaagcatttgacaaattcaacacccctattagtttcctaaggaaactaaccaccacaaatgtactgtttgaaaacaatacaaattcagtctctcaaagctctggaggccacaagtccaaaatcaaggtgtcagcaaagccatgctccctgccagatctcccggggagagaaaccattcccagccttttacagcttacagtgtctcctatgctcctcagctaacagtggcaccgctggaactcctacctctgtcttcatatcacatgtttctcttggtgtctgttttctcctctatgtgtttcatacaaaggcattcgtattttggatgtggggacaccaacataatccaggatgatctaatctcaggatgtttaactacattccatctgcaaagacccattttccaaataaaatcacagtcaccacgtctggggacaagggagtggacatgtcgttatcgggggccaccatcaagcctgctgtaacgtctgttcatgacaacgtctcagcaaggcaggaggaaatgggtcgtcctcagtttgtgataaagagcacttacaaaacaacaaaacaaaacaaaaaaacacttagaattaaccttactgatgaaagactggatgttaccccctaagagtaagaacccaccaaggatatccactcttcccattcagtatagtgctggaagctcaagtccattcaaaattgcaaggataagagaaacagggcatacagattgcaaagaaaaacagtaaacctgactctacttgcaagtaacgtgatcgtctagatagaatttcccaaagaattcacagataaactcttagagccaagaacccagtttggtgacttcacaggatacaggatgaacaacaacaacaaaatctactgtatttctatataataatatgaacacgtgaacacccaatttctttaaaatacaatttataatcactcaaaacaatgtaatatgtggaaatctaaagaaaactgtatatgtataggactcatagactgaaaactatacaatgctattgaaagaaaccaaagatcaaaataagtagagagatatagtatgttcatgtattgggacactcagagtaaagatctcaaatctcccaaattgatatacagtttaatgcacctgttataagaatctcagcaaatatgttttgtagatatgaacaagattattctaaaatgtgtatgaaaatgtagaggaactggaatagctaaagtaattttgaagaacaaaattgagtgggaaaagcaccttacccaatttcactgcatattatatagctccagtaatcaagaccatgtggtgttggtggaagggcagacacagagattaatggaatggaatagaaagcccaggaataaacccacagaagatgccctcctggtttttggtaaaggggccaaagcaattcaatggaggaagaatagtcttttcagtgaatggctccaggacaactggacatacataggccaaaaatgtgcctccatgtgaatctcacatcttttacaaaaatctactcaaaatggataatagacttaaatgtaaatgtaaacatataaaagttttagtaaaagatatgaggaaatatttgcaatctgagactaggcaaatatttcttagacttgtcccccaaaacataattcatcaattggaattatttaccaaataattgattattaccttatcaaaatgaaaaacatctcggagaaaaatcatataaagaacttgaaaagataagctgtagactggaagataacattttcaaaccacgtatctgataagaactcataaagaactcttaagactctacaattacacacacacacacagacacacacacacagatacacacacagagtcacagagttaggatatgttcagaagacctttcaccaaagaacatgtaccataaacacatagaacactgtgtaacacctttagctatcagggaaatttaagacaaaaatgagctattatacacagctatcaaaatgtccaaaattaaaaatacatattaaaaaaaaaaatatatatatatatatatatatatatatactgacattgccaaatgctctcaaatagagaagttgagtcactcaaacattgctgatgggaatgtgtaatggtacagccacatttttaaacagtttggcaatttttttctttttcttttttttttcttggttttttttttttttttttttttttttttttgagatggagtcttgctctgtcacccaggctggagtgcagtggcacgatcttggctcactgcaacctccacctcccagattgaagcaattctccctgcctcagcctcctgggtagctgggatttgggattacaggtgcccactaccatgcccggctaattttgtatttttagtagagatgaggtttcaccaggttggccagactcatcttgaactcctaacctcaggtgatccacctgccttggcctcccaaagtgctgggattacaggtgcaagccaccacacctggccagcaatttcttataagagctaaacatgcaattatcatatgacccgacaattgcacttccaatcatttatctcagagaagtgaaggcttctgttcacataacataataataagtaatagtagcaggaatatgtgtagcagctttagtcataatagtcaaagacaggaaatcacccaaatgtcattgaagatgcaaacagttaaacaaattaattcatctagaccatgaaatcccactcagcaataaaaaggaataaactattgatacaagcaccaacttgatgactctccagagagtggtgctgaccaaaaaagtcaatcccagaaggtcacatgcatttctacaacattcttataggaagagagaagagattagtagtggccaggagttaaggagggaggtgttgatgggccaaagtaagtgtagctatcaagggtcaacgggagggatgtctgtgttgctggacatgttctgtatctcacctgtttcaacgtcagtatactggtggtgatgttataatacagttttgcaaaattctgccattggggaaagctgcacgaaggttacacaagatctttgtaactgcctaaaacttacatgagaactttgtattacctcttacaactgcatatggatctataattatctcaaaattcaaaaatttgttaaaaataataaaaccccatggtaattatttaccaaatcacagatggacctgaatattcaaataattttaatagctaagtctgaagcttttctactgggtaaattctatggatacttaattcttatttgtacaaaaacctctattttagaaataggtatcagtactttgggaggctgaggtgagcggatcatctgaggtcagcagttcgagatgagcctggccaacatgatgaaaccctgtctctactaaagaattagccaggcctggtgacacacacctgtaatcccagctactcgggtggctgaaacaagagaattgcttgaacacaggaggctgaggttgcagtgagccgagattgtgccactgcactccagcctgggcaacagagcaagactctgaaacaaaaaaaaaaagaaaagatatcaattagctgcatctatagtggctttggtgggaacagggtgttctgtcttccttttgactgtgattagaaagggaaaacattaatgttaataataaattataatcacaaccatcttctatgtaaagaagagaatctactctgaaggataaataacattcattgaggatgggctcctgcagtccagtttttccctggatacgttggcctctgttgaagtttctttgagcagggctggagaagctgccagtgttgatcttatttcccgctgtcccattagaataaatgtgaattctgtttacaaattacacagcccatttaattcagcctttaggataagtcagaactgtatgaattgccaaagagggttttatatgaatgcaaactatacctcatagataagatttcccgagttgaggccaataataatggagtggggttgacgtgttgagagccgctccgtcatttgggatgcctgtgttgtcttcagtgaatggtggtattagacaaggatacatcaaatcaagtgagcaacagacaggatttttatgagttttccccttgaacagtattatgataaattcacacaattgcatttgatttttttccctccctaccaggaggatcaagcaaagaaaatgagtttgcacttcagtctttgaagtttttcgatgcatgagaaccatagccagagataagaattaagctccacactttaaatgagcaataagccaggttttcaagctgtcttgtttaagtccctgtctgcttcttgcatgcttttttctctcttttttttagcttcacactcttttttttggagaagccatacataaagtggctgagaaaataataattggcattaccttaatgttttcatctctaataatcccgaatcataacatattagcatactgacaaaaatctatagccatggacagtgtttgttttgagaagagaagaagaaaatatctttttttaagccttactcctaaaaatgctcattgccaatgtgttgaaaagactgccttttactcagaaagcgtttctaaggtgtcgcgtatatagaacaatacaagactcacacttttcttgttttgaaatacatgtaatcactatgttggtgtgatgtttattatgatcaataataaaacatacgtaagatttataagatatagaaggtagaaaagaaaatgaaacaatgatatagttaaagccactaaacattacacttaatttacataattaattttatgcatattcactgaatattgtgtgccaggcactattttgagggctgggattacgtaagtagcaactgggcaaaagaccagctctcacagattttacattctaatcagacagttttgcagtgaaaataataacaataatagtaatatataacctgtctcatggcttctaaggcatggactttctcacctttttgtacctctgatatgggatgtatcttactatcgcgttggtaagagagactcatgtcacattttaattttctttttcaatagtgtatgaagtaattaagcatcttataatgatggtatcttagccttgatgttctcccaggtggtaataaattcaataaagaaaaatgtaggggaatggtcagagggctggagagtgagggagcctctgctccttagggtggaaccagcagtgtgagtctctggaagggagtgctggtgaagggagtggggagctgcccacctgggtagctgggatgtgtcccagaagagagcatttgcaaatacaaagttgcaaagtgaaatggcatggattgcatctggttaattgcaggaagaccagactaagctataggggaagactcatccaaggggaagatctttccagtggggcagaagcaaagtcaggaggaatcaaggcatcagccccctgccatgtttctcttgtcactctgcaatcagaagccatggaagttttgtgcagggcagttgcctgacctgacacacattgttcgaggaagaacctgattgagtgacgtgtagggtgttgggatgggaaggaggtctgggtgaaggcaggaggtaggacggaaggtgggtggcaccgtgcaggtgagaggagttgcctcatgtaacagctcatagtcatcaaggtcgctaggttggaggtgtggttagaagacagacatgacgagatgtgctgattcgaagtctccatgcaggcggagaggtggacagagtggagaggtggacagagtgggcttcaggaatgcccaaaagcctgaaaggattggacagaatgtggtggtctaagagtgggatgtgttcaataggcatccacaggtgatgtttcaggcatttctatgaggtctccagagaggtggcgggactgggtggctgggctgatggagaagaaccactcagggcatctgtttcagcccctctgccccatgcttcatctttcccagtgaaatatgtgcagtgaaatatgtgcagtgaaaacacatattaactgtcagggatactattttctttcccagggagctctgtgctctgaggactgaacatatcaaggggcttttttgccctctgacttctcattgggattcaccaaaggggagtgactgaggccacagagtgagtgaagtaggggtgtgctgtctctccgtctctcttccatggattgccaaaggtagcagctcccaccaggggcttctgtcctctctgctaccagctcccagtcctgtctgctaccagctccctgtcctgtctgctaccagctccctggggggataaatggatccactgtgaacagcacatgggaactgtgctgactagcccgtgatagttgacttaaaccaatcacaagtattcccgatatttcctgcattaactttttttaattttccgatttgagtgtgccacttcctgccagcactctgactcatagaaatataggcgagaagtgtaaggaactgtctgttccaggagatgaatacaagatgggagcagacaagctatctgcggatgttaaattagtgattttattcagcagcaaaatgaagtctatggggcaggaatgagggggatatggagaaaaggtggagagatcagatcaaacaattaggttgagatttaacactaataaatgggatttcctcatgattttaggctggagaagtaatataatctaaattatgttcactatttagaaggaaatatttgtacttcataatcaaggcagaacatttttgaactgtctataacaaaatgcagtgaaaacacatattaactgtcagggatactattttctttaatataggcttgtatggaataagcaaatattgaattaactggaactctttacaaatgctcagaagaaattaaatggaaaagtcataaaatcaccttgatctttaattttggtattacatataggaacatctactggtaattagatgagttttgcattagagattatatcaacctgaaaatgaaacacagttttaaaaaacgatttagtcgtaccttacagaggtaatattctgaaaggacgctggcataaatgggaaatgttctaaggaatatttactatgatggccttatctaaacatttactgccagagaacctcaaaggtattcttatataattctaaggttactctggaaagcatcagatgctactaagacctcaggtctcataatcaaagaatgccaggaatgatgcgattgttgtagttcatgagaaagcagagaaatcactcagtgctttgccacctaaaaggaaatcgttagacttccagaggggagtcttgcctgggagccatctgagattttgcagggttgagcaccttagtccagggaactttctagctgacttaaccagaagttgaagcaggaagcaatttccagtgcaacagagaatggctgagctgccacgggagcccgtttttcagtcctagaactgtgcactggtgaatctgctctgaagtcttacgtagggaaataaaagtcaacacaagcctgaatttaacttcagattagaaaataagaatatggggttgcaggcattctgtcactttccactaagagagaagcatctcaccaatgttgggcgctaaatggccatctgatgggccaagacataaagaagatgccctcgtcagcactagagtgtggcacgtgtgcatggctttaatgagaaaataatttagactgtccgaaagaaccatggtcattacataataaggagatcttgaaaaatgaaccaagaagcaatccgcccacaccacacaacaccaaccacaaataaagaaaaaataaaatatttaatttaggagcaaaggggatattaagaaagtgggtagttcacttaatgcccattttgaaaggcagaagggattctcattgaaaatatttgcagaaaaacagtcaggcagtggaagtccctgtcaaggaaatcaaaataaagctatatggtcagaagacctggagataagttagaagaattttgaagaaacagaaaagtaactacatctctatgtcaacaactgtagttccacaaaagttgtctaataaagtttatttctatttcattcattgtttcttcagaatcccaccatgtttatcaaaatgcaactttctaaccttccaatctctgtataaaacgtatttcttggattataacttttaaaaactaggttgctatgacacagttttcaagtaaatttattttttcaatgacttgtttgcacatcttaaactgaattttgtatgccatctgctactggaagaacctgactgtaacccccccatttattgataaggtatgttcttcaatgattagaagaaatgtaactgtgtgtgtctgtgtgtttaggcattactctgatgactatatttaagcagatccatttcacataaacaatgtagaataaaaataagcccatgttggccatgtgtagtggctcatgcctgtaatcccaggactttgggaggccaaggtgggaagatcacgaggtcaagagagcaagaccatcctggccaacatggtgaaaccccatctgtactaaaaatacaaaaattagctgggtgtggtggcacacgcctgtagtcccagctactcaggaagctgaggcaggagaatctcttgatcccgggaggcagaagttgaggttgcagtgagccaagatcgcaccactgcactccagcctggtgacaaagtgagactccatctcaaaaaaaaaaaaaaaaaaaagcccatattgaaaacaatttttaactttcagtaatgggaaggagtaacaacttttctaaaaattatcatttctatttttgcaccaaagacttggcaaccattacctgcaaaagctaagcaggaactgtcgtggtataaatacatttcatcacttgacaatgctaaggagtaaacactttaaatgattttttttcttttaaccgtctatctttcatttgcatagtttctcaatcccaaatattttatttaaaaatctatttatttaaaaggtgttttatttttccatagtcatattcagttctctacccatgcctcttcctgattataatgcccagattaagaagttcaggtattaccaagcaatctactgagtcatctttctggtaagttgttggttgataactaccaactgggttctgggacttttcctcagaccctattattatgttataattttcagagtaggaacttcaaaaatttagcagaacatggaattcacacagtgatctcttacatgatcacattcgagtctgtgatactatcaagcatctactaacatttgaaagaagtgtgacacagtaaagtcatgtcaaggcaggaagtaagaggtgctgcagaagagcagccgatatcttatctcactgtgggcgtggtggcaggctggtaggaaatgacaattgtatggaataaaatatttgttttctccaatgttatgaataaataggagcaaattttcaaagtcattgaacaagttatcgttgtagatagagcaaaagtaaagtgagagatgtgatgtgtttcctcttaattttagcaagactatgggtcatatgttaccggaaacatgaagggagaacattaataaacaagttttgtcagttgtttattggtggaaatgaggtaaatcaagtagagatagaagaaaattcaagtaaagtataatttaactctcatacaagggatggaagagaggcatgcactactggaaaaaaggcatggggatgggatgggtcagggaggcggcaagatgaataccagttaaatagccttttaaaactgaaagtgacatgctgacttccgggaaaagacaaactgggaatacaaaagcggcacactaaagcaactgcctagtgggaaaatgagatgggaaaattttcactctccaagttactgcctttctgtagagcagaggagagtatgcagggttagacaagattagtgatggcccaggtgtgacatctgcacatgggagggaaggtgagggatggggagtttcagctgttgcatggacctgtgtcttagtggaactgggaaatcctaatctccatcatccctcttccatagagagtccatagagttgctagctctgttggtgttttaaccatattcattttctcatgggctccttactgtctagaacagaaagtctggaagcctggaaactgcatttcccagaatccattactagcagggttcctgatcttgctaaggaactaaaaccaagaagagagatttaagggctcagacaatgcagtgagaaaagaccgaactgaaccctccagtttactagtcatgcaactattcaatgcttagaatattatccaattttcttcaattattttatctgtaaaataaggtaaacaatagaacctatcttatatatttacaaagagcttctttgaatttttttgttgttgttgttgaaatggagtctcgttctgttacccaggctgcagttcagggccatgatcgctgctcactgcaacctccacctccagggttcaggtgatcctcttgcctcagcctcctgagtagctgggattacaggcacctgccatcacacctggctactttttgtatttttagtggagatgtggtttcaccattttggacaggctggtctcaaactcctgacctcaaatgatccacccgcttcagcttcccaaggtgctgagattacagttgtaagccactgtgcctagcagaaaaatgctttaacatgttgtaatgatgaaataaagggacttcataaccatcatctacttgataaacattaattaaatacctactacatatgtcagacaatttgttcagcattaaaaaaataaacagaagacagatacagcttccactctcatggtgtttataatctagtttaaaatctatacaacacatacaaaatgatttctacatttctcagcacatagtaagcagttattaaatgtcacctgtaagtattcatattgataataatgatgtaataacatctcccttatagcagatagtcctacatatcagtggaagatgtatcaaagagggaagatgagatattagaattcccagtatagttgtgtgtatattcatatgtttgtatgtatatgtatgtgtgtatatatgtatatgtgcatgtgtgtatatatgtatatatgcatgtgtgtatatatacatacttggcaattatatttttgttctgatttatcctcttttataattaaatttgtacatgtatacccatacacacatacatacatacatacatacagatatcgattaatacatatcgagattgacaaatataagaaatagacagtgtggccagtgcccctggtgtgatctggtgcacagtttatgtgaccaaactcagtagtgctggctgttgctgtggatgtatttttgtgggggaggtgggactatctgtaatttattataggtaaggtataaattacaaaccatagaaaacaacaaccatagactttatttcatagaaaattttacgctgaaaaacctaacaatttaaccatttcattaagttatactttatgcacaagaaatgcagatattcaaaagtgtgcaattcgatgagttttgataaacatcaacccttgttttcaccacccctcgtcaagatattgaacattgttgacccctcccagagtgcgaatacctcatagtgaaagatattgaacgttcctgacagcccccaaagtgtcttcatgcctttttccctgcaggggcgtttaagaatgaaggtcagtgaacatctgtgtacaagtgttgctttggacatggcttccatttcccttgggtcactacctctgtgtggaagggccatgtcatatattaactacatgtttaactttttaaaaagttaccaaattgtttcccaaaataatttttgcattttatatttccttcagcattttattatcatttctgtttatttatgcttcagtacatatttacattgtgaaatggtcaaatcaaggttcgtagcatttgcatcatctccaacgttcagcgtttctttacggtaaaaacattgaaaatcctctcttctagctattttgaaatataccatgcaatattgttaagtgtaatcacccttctgtacaatagcacacaagaacttcttacttctacctgagaccctgcacctgttaactcatctctccccattcctgtcctcctgcctcccccagtctctggtaaccaccattccatcctctgctccaatgagatcagttttctgaggttctccgtaaaagtgagatgatgatgtgcttgtctttctgtcactggctcactttacttaacaaagtgtccttcaggctcatccgtgttgctgcaaatgacaggatttctttcttttttatgaccaaatagtattccacatttttaccattattcatccattgattgacacctcggttctttccgtatcttggctattgtgaatgattctgcagtgaacaggggagtgcagctatctcttccatgtactgatttcatttctgttgggtatatgcccactagtaggatgactggatcatatgatagttcttttttacttttataagaaagctgcatactgttttccatggtggctgtactaagttccaccctcactaacggtgaactcttacacacagtttttctaaatgtttgctgacatttggtatggtcagtcttttaagggttgctatgaaagtcttttttttccccatcatttttatttgaataccttctttggtaaaatatgctcagtataaacagtttggggtgatttaatattcttgacagtttcgtttctcgtgccatttctttaaagcccagcttctgtcaagatttgtactgtaatttgaatattggcataagctgcaagagttatgcttctcttgaggcctggccattcgtctctgaataaggaagcagttctggctgcagagccgtttgtttgttttctaaagtgacttttaaggtccccccttcctcgagtgtttaacagtcaaggaaattcattctacgtagctcacatatcacttttaggtccccaaccatatagttgaaattagaacttctaaaacctatataataatttaacatctatttaatttcaaatttcaggtgctgtaagaataatagctattttgtaattaccttcagatataagtaatggtagacgcaacgaagcagataatgcaatttgacaaagttactatgttcttcatggaattaaggcttaattccattttctaaaattcaaaattcctttaccttattaattcctgattctgcaagggcgcttgtcagccctgtgaattatcagttgagctcataaactgatgctaacattacacattgacagtaatcgatttgacaggcatacgcctcctctgctggaagcaattggtcctctagagagggtttttaaagtagtctcttgtttcctctctgaatttcattaagataggttattattagcctgattaaattaaatagttacttttacatttccatggaatttgaaaaaaagttgataaaagggataaagtgagttaacagaagtttaataaatatcattatttttgtgggatcactctatgaacactagatttgcagagtatggtcaaatagattgtttcatatctcatagatttgaaatatgattatttccatacacctatattgatgaagaaggttctttttacttcatccttattaaatattttcatcatttgactgtgaaaatcttcattttaaaggtttcaaaaatatatatataggaattgtggaatcattacatattgttaaatttttatgattagttattattaaataggagacagggaccatctttttatgagaagttttgacttgaagaaaaatcagtactgattcatttccaggacttcagtttgcacttctgattttatttgtgtcattttgtggtttgcgatgaagtaggctggccttgaaaatctcaaagcaaaataaaatctgaccagttcttgttatgcttattcagtgatatagtttggctgagtctgcacccaaaatctcatcttgatttttagtccctatgatccccataatcttcttgtgtcaaaggagaggccaagtagagtgatcgaatcatggggatggtttccactatgctgctgtcgtgatagtgagtgagttctcatgagatgtgttggttttataagtgtttggtaattccccctgcattcctctccttcatgccgccttgtgaagaaggcactttgcttcccctttaccttccaccacgattgtaagtttcctgaggcctccccagctgaactgtgagtcaattaaacctctttcctttataaactacccagtcttgagcagttccttatagtagtacaaatatggactaatacatccagtgatttggaacatgaggaaactaactgggcacaacccattaaatataacttagcaccaattagtttatgtcaggcctacattttagtaaactataaagtttagcacaataatttgacttagtggtttgtaatgtaagaaaaataaagtaagttgacaagtttttaaaaagttaattatggcatctcaccttgaaagtggcagtgtcaagaaataaaaacataaataaaaaattatattgccttgtatcttcatctgtcctggtgtttaataaggagaagtcacttaagatgacattgaaggaggagaggaggcaattgagggaaagagcaggtggacagtctccagcttccttttccattaattgatttgaaaagtgatgttcctattttttaataaaaaagcaaagttagagaagtcgagctaaattagatccaaaaggggagttccaagtatctatgagtctcatgatcactgtctgatacgtaacctacggaacaaaataacctctggtacttaaaaaaattgatgatcaagaaataatttaactcatgtgatgtgcaggatggaacgtttaggagtagtgtgtatattactgagaatgaaatcctgattctaatacagctcctcacatgctctgcttttgtatctactgttattgaaaggaaagtattagggataggacaatacaaatttggaaaacgttaccaagtataattcatgcaatagtctgttctgcttttttacattttcacagattatcaagaatattttcagattggcacagattttttttaaataattctttctgattctacatagacccagcttttttgttcacagagacacattttacttgagataaaaccccttttattctagtgggaaatacaatgcagattccattactcaccttttagagatggtagacactaaaatcttttgtggtcatctttgatcagttttattctaacaggtcatagttcttcacctcaatgtcaatatacgtgaatcaaggtgctgaaatttaccttggttaaatttgctgtctattgaataaaaagagagaaaaagggtatccgaacctagccagattttctttgatgtttttcttcagggcagaatgcactaacaacaacagaagagtaatgaaaactctctgggctccctgctgctgggacagggcatttccttttttttccttttttctttcttctttttttttttttttttgagaccgaatcttgctctctctcccaggccagagtgcagtggcgcaatctcagatcactgcaacctccacctcctgggttcaagcggttctcctgcctcagcctcccaagtagctgagattacaggcaggtgccaccacgcccagctaatttttgtatttttagtagagacagggtttcaccatgttggccacgatggtctggatctcttgacctcgtgatccacgcacctcagcctcccaaagtgctgggattacaggcgtgagccaccttgcccagctgggacagggcattttcaacatacaggagtttcccttgtcccaaggagataagctctaagtcccccagtggatgcctgaaaccaagccatatgtattatgctttctctatgcgtacatactcctgataaagtttaattgacaggctagacacagtaagagattcacaacaatgactaatgataaaataggacaagcatggtggcgctttgggatgctgggacaggaggattgcttgagcccagggacttggaaccaggctggtcaacatagtgagacccctgtctctacaaaagtaaaataaaatcattatctgggtgtggtggcatgtacctgttgtcccagccactccaggggctgaggtcgaaagatcacttgagcccaggagcctgagatcatagtgagtcagccatgatggctcccagcctggaaaacagagtaagaccctgtctcaaataaaataatatttaaaaaaatagaatgatgataacaatatgccaatttcattactcttgggcaattgttaagtcaaataagggttccttgaacacaaacactgtggttccttgacagttgacctgataatcaagaaggacaattccttcctgatagaaatggcaaaggaagtaagatcattgtgtaatcacagaaacacacatttttttctttatttgaatgaataagaaagattttgtgttcaaattgtgatactagggttacatttttgaagtcatattgttttactaagtgtaattacaaaaactacaagaacaatagccaagtaattttttaactttttttctctatatgacctaagggacaatcattaagttacacatattcgcatacaaacagtgaataaatacacagactagacgtgctaccttgtggtatgttttgcttggtacactctcaatgaatgcagtaactgggcaatgtgcgaactattcaatagcttcccaagtttgctaatcagagattattaagtcagattgtactcaaaattaatagactaaactaggcaatacctggcttttgcaaagaaatatgataaactctaattgaatcatggtgtatttcattatgctcttagatacaaatgagcttcctgtactaaacaaatatcataaactctaattgaatcatgatatatttcattatgctcttagatacaaatgagcttcctatactgataaatttgtgttcatacttataattgaataatgggtgcattgaacataaaacaaataatttttaaaaggaggtaaatttttttaaaatggtacggaagagcttggagagaccactttttcaccaacaaagaaaactggtactgtgaatcttttctgattttgtaagtagccaaaaatagttaaataattgaggtgtgtgtttatttgagggtcgccattaatttgtctaaacacaagcagctcgtgccgtaggactggtggaggtgacttccaccatcccagttgtgaggagagacaaggtcgctgagggagtacccattcaccaaaaagtatgtgcctattctgtgatccaacaattccacccctaagtgttcacccgagtgaaataaaaacacatttccacacaaagacctgggatggaacattcgtaagactttcttcataatagccccaaactggaaacaacccaaatgcccatcagctggtgacaagatagacaaatggtgccaaagccacagagtggaggaccattgagtcagctggtgataagatagacaaatggtgccaaagccacacagtggaggaccattgagcaacaaaaagttcataactactgatacagggaaccaaatggatgaatctcagaatcattacactcagtgaaagaaaccagagacaaaaatgtgtgtaccctatgattccatttatatgaaattctggaagagagaaagctatggtgacagaaatcagatcactggttgccaggagcaagggaaagggagaaaaaatggactgaaaatggatatggaggaaattgtggaggaatgagaagcctccataccatgattttggtgttggatacatgactataacctttagtcaaattcgtcaaattaaattaagactccttaaattgttcatttagacgtggtaaaatttgtggtacctaattcattccttaattaaactgattatttaaaaatatcattgaactatgatgagtaataataagtgaccccaaaataatttaatctgtttaattattttttaaatacataggactgtacaactcgactagctggtgctggtgtttgaaggtgtctcctgtaaaattcaggtgttgccaatttggtagcagtaagagctgtgacccttaataaagagcttaacaaagagaatctaccccttttgcccttttccttctgccatgtgaggacagtgttcctccctctggaggacacagaattcatggcactgttttcgaagcagagagcagttgtcatcagacaccaaccttcccagtgcctttatcttgatcttcctagcctcttgaaccatgagaaatacatttctgctcttcatacattacccagtctatgtttttctgttatcgcagcacaaggggactaagacgatgaaaaatacataaaatcactggcatcagaaaaatgcatcgaaaatagatttgaaatatttaatttatttcccacttgattcccaaaagacagatcatggtctagccctattgtaacatgctctttttcaaaatttactgttttgtcttctgtcttctgtttgtgtcttacaatagatttcttcagtagtataccttttaaaatgctttcagacagactcaattataagaattactgaaatgcacatgatatttttgaaagattctttcaataggcattttgggaaaagtgagtggaagaacaatgtggaaagtggccccaaatccaagattcttggttcctctttcaggtttaacttctggctcattttttccaactccctcaacaaaccccaaattattggctgagcattgatcaggtacccagaattgtatgccatcaagaatgctgagtggctaagtgtgagtccagcccttgaggaaacagcagccccttcatggtgagaggcaacaagactgaaaataagtgaaactaagtttcaaaggaatgaaacactggtgcagagtagagtgaccttggagatttcattgatcatctagtcatgggaagggtagataggtgtagatgatagaatccacgctaggacatcagggctggacatggtggctcacgctctaagacatctgtggggccgggcgcggtggctcacgctctaagccatctgtggggccggttgtggtggctaatactctaagccatctgtggggccgggcgccgtggctcacgcctgtaatcccagcactttgggcggccaaggtgggtggatcgcctgaagttagaagttagaaaccagattgaccaatatggtgaaaccctgtctgtacgaaaaatacaagaattacctgggcatggtgtcatgcacctgcagtcccagctactctggaggctgagacaggacaattgcttgaacctgggaggtggaggttgtagcgagccaagattacagcagtgcactgcagtctgggcaacagagcaagacactgtctcaaaaaaaagaaaaagacatctgtagaatttataatttagaaatctggggattttttttatcttggggtttaacacataatcaaacaggctaaatattatcttgaattggctgatgttactaaagtctacaaaattgttattttcatagtgagaactcctctattctttgttttgtgtaaataaaatgaagtctttgataaggtagagaatgatgtttctcttttcttaatcacaacctgggattgtatatagtaactctcatttgcatttggtcattcctttatctctgcccattcaatgtgtggctccctcaggaatgtgggctcagagcagtccttctcgtcctatatccaactgtttccttgtggaggacctactcagggccaatccctggatccagtctctgaagaccaccaccttttatactttaatgactctgcattttcctccagacttggtttcaactgtcttgtagtatgagtttaagaaaagaaattgcccatcaatttaatagaatgttaaagatgtaattttcattttttcatactgaaaatgagcatagaatcagcaaatgaagcttcgtcttcagttattgtaataaaatgaccaccaccacagtaaaactttacacagcttttagtgtcttttttttaataatctacagcacagaggaaaactataaataggcagtattagtctctttaatatataataaattctgattattagataactggaccaagagaaacaggaaagagtgatttttctcaatcatgggaagcattttacttattatttttaatatattggagcgtgaacaagtaccatctttatgtgtttaaggaatgttttcaatccatgcgcagaatggtgaaagtaatagaatgttcaaagtcttagtattccataacctatgcctaaaaggaatcattgcaagcgtgacaaaggtattaagacccaaaagtttagaatttgactaatttttaaccagaacagtagtacacatttaaaaacaacactgatttcttttttcaaattaacatttttgattttaaagtagttttaggtttaaagaaaagttgcaaagatagtacagagcatttctgtccaccccacagccagtttccctatatttaatactttatatcgttaggtacatgcatcacaacatggaaacgttattaactgaaggtcgtattttattcagatttccatggcttttttttttttttcctagtgtcctcttcctgtcccaggaaccacccagatccaccctgagttaattgtcttgcctcatctggtccctctgaattgttactgcctttccttggtttgatgatcttgggtattttgaggagtcctggttggtattgtgtagactattcctcaggttgtatttatctgatgcttttcttgtggttagactggggttatacgttttccaggaatatcataaagtagttgtatcttttaaggacttttatcaaataattttgaggacttagcttggcttttcttaagttgaatgacttcccaactattgaaattaaaagtaatatcaatgatgatgttaataataatagcaaagagatagaacttaatataccctgggctctatttaggcactgtgcattggcttctcatgcattggatctttaaggagatgcgaacgattattatccacaattaggtaaacaggtacttctagcaactcacaggaagtcacacagataattgatgttgctgagattccatctaaaacaggatctattccaagagtctatatttctactcactttgctatcctgcttccagactgtggtctagaagtagcaggaaaataaagcaattaatttatgcaaaactgtattgatgaagattatttcttttaatgaatctagatatgcagatttttttcttgacatgttggctatttggtatttgattagaacgttgtaggtgacgaaagtaatctgaattatttctccactttttttttcctatttatttgcttctcaatcctgttgataaaaggggttacgaatctatagcaattggccagacgtgggattttccaggtttcagaatttcctagttagctgagggttacttgaatatcctcctcctgacaggcaaacacaaatacatagagtttttattaaaaatcagtgtatatgcttatttaaaaatacaaatatgtgtgtatttttattacttgaaaaacagaaattctagaatagtaaatttttattcctattttgttcatctggcttcatctggtgatcagcaccttcatccttcattttcaattattcattttggaaacggcagtggagttagttttatttttgaagtttacagtgaacctgaactcaagaatcaaccaggagcatctggttggtgcagattgtaagcctgatagtatccttctgtgaggatgaccacttaggtgctcagaaatgtgttacttgataaggcaaaaagttcagttcctgctgagttaagaattagagaacagcgcagcttgcgtcattgagaagcctcgacctccatgaggttcctagctggcgtttcagccttaaacaatggcaacagacacagcagagcattaactatttgtatgcctcgagtataatgtaagtgaaaggaacactatagcaagatgatttttcaggactaaatttctactaattaattctggaaagtaaaattgcattatgcatacctttcatgtattctgaggtgcttctcattactaccttggctgttgtattcgttttctatgtctttaaaagaaatctataatattaaaaaggaaaaattctatcctttaaaatgactcattcttccttctcatttcctactatggtctgacattagtttgtgcaatcccgtgtgtctgcatgatcaccaatttggaaattcaatggagatgtcctgtgatgttaatgtagatttctcttgctctggtgcagggcagtgggatcactggaaaacctgcttctcattacgttgcaggttatggcagacagacctgttgagctgagacacaggacattgttggatctgaatcttcagctcaaaatcaatgcttttatatacccaaatcgggttactagatcagcgggaccgtcagggaatttggccaagtaaatatgactccatgattatagctgaccaatatcttgaataaaattgttgctttcccagtaagtgctctctgacatccagtctcttagttttctgggcaggatcaccaacaaagttctgaattccaacagcactaataaataatttggacagtgctataaacaagtttgaaaatctatactctcatggtctccatgagacaagcgagatgagctgctgagacagttcatttctgtggttacttatagcccgaatttccagagtccagcatttcacactggggccacaaaagggaaggaaaaacacagcaggtgtagttcccgctccatcttagcttttgactacacctttggaatcatctcattcttgtttcagtcaaacaaagcacatttgtatgaaaagcaaacatggtatttcatgtacacaaccgaattttccctgagcaccataattaagcacgatcacacatcattttaacaagcacaggccactgtaacagcaatccgctactttctgggcttatgtcactgatggtgacggacaaggagagagtcatgggaggctccatgtctgtccaagtgctgggttgtgctgtgtcatatggttttcagtaatgccgggagcatgtgccacgtccataccgcgtggacatgttctcacactgtctccaaaaaacagggtctgtagacttccatttatgtgctgcaatcttgttttccgaaggtgatgaaaatatatcaattagtttagggatttctgagtgaaagtctcagggaaaaaaaatgagaatctaagagcaggcacagtgtggtcagttgcacaagaaactgttgcttttactcactctctcttcagcgaaaatggaagcatgtactgatttctgggccattttaatctgttcattaacacttcccgcatgtagtagctatggcagccctggaacacaccttatctattctagtttgtgattaaagtttttaagccttaagttcagaatacagatggtagtcaaatagcacatgagaaaaaaggcagacatacaagctagacaacattgctttcatacgaataagcatataagaagttgtgtaaatatcttacacaggcaataagagttttggtctgctattttgggagataaaaagttagctgtctgaaatctaaatgttttccactatttttaagaaatatttcctgaacagctacagcagagtgttttctgcagaatattaattgcaatccagtagcaaaccgtatggaatttaaaggtccctcttatttatggaacatcatcatagtacatctattttgtgataacttgaagaatctcaactcttcatggtaacaaagactgcagcaacctgctatatttcatatgtcaaacagaaattgtattaccccatccagaataaatttggtaatgcaagcacaaccgtgggagcagaacgtggtgtgatttaaactcttggtaaatcattctcactaaaattcagggatatcagcttatataatccaatagtcatctattgagatttagagaaattgctgttcatatacatgactatgggtgaacctaattttagaatttagttttattcattgagcggttttatacaaagaactttcataagtggttttggaagggaagagaaagaacctgataaagctgtcattcatggagttctcatctacttgtggagacaggtcacagagaacaaagaacacacagcagtgtaggctcagtgagttctgtactagctgtcttgtgtccatgtacagtgctgccttgcctgacatgccatcaacatgagaaatggtgttagcaggggatgtggccacagcagaatctaaaggaccaggcaactccctggacgtgtttccatgtagctcctgggacacccatggttgactacacaaaaggaaacaagcaagcgtgctaactatgcttctgacggcacagttatgtctcattcctttctgccttcttagctctttttgaaattcaagtatacaccgaatacattcttatgtggaaattggatgtttaaaaatccatcatagtccacattcatttatttctaccttcagagttctttttctctatttctcttgtagtgtttggtcctctgttatttgttttgttaaagggccagttttctaaactatatctaaagaacacttttttttttttttttttttttttgagacggagtctggctctgtggctcaggctggagtgcagttgcgcagtcccggttcactgcaagctccagcctactaggttcacaccattctcctgcctcagcctcccgagtagctgggaattacaggcgccccccaacacgcccggctaattttttgtatttttagtagagacggggtttcaccatgttatccaggatggtctcgatctcctgacctcatgatccacctgtctccgcctcccaaagtgctaggattacaggtgtgagccgccgcgcccagccaagaacacttatttttaaaaagaattgacaagtgtgaaaagtcactgtagctagtggctactcattgtaagtgccaaaaattaaatatcatatgcaactcaaaatcttctttggcaatttaaaaaatctcacttattctcatgaaaacttggggatatgtttctaaacaacatagatccattttaccaataaagaagttttgtcttccatttattacttgtatacttttccatttttccagatctcagtctgaaataaagaataaaaagggactgagcttcatcagattctccagaatatataaaatcttcatataaatacaacatataatacacacacacctataaatgtgacatacaaggccaggcacaatggctcacgcctgtaatcgcagcctgttgggaggctagaggagggcagatcacttgaggccaggagttggagaccagcgtggccaacatggtgaaactccatcgctgctaaaaaatacaaaaattacctgggcgtgatgatgcatgcgtataatcccagatatgcaggaggctgagccaagagaatctcttgaatccgggaggtagaggttacagtgagctgagatcgtgccactgcactccagcctgggtgacagagcgaggctccatttcaaataaataaatgcaacatgtaaataagttcaagggatctcttatacaacatggtactatggttaataataatgtattatattcttgaaaattgctaagagtataggtgttctcaagaaaaaaatcagaagtatgtaaggtaattagtatattaattagctttgcttagccattatgatacgtacacatatttcaaaataacatgctgtagatgaacaatatatacaatttaaatttgtcaattaaaatacaatttagtatgtaaatgtgagtgcgaataaaaatcattaaattgcaagtttaataagaacaataatttagaaaagcatctgttgtgtgttgactctgaacaggtgctacagatttaacaatcaccaagatagaccctgccagggcttacagtaaagcacaaaaagtacatataatgcagagtgacaggtcttgccgcagaaaagagagtggtgctagagacacgtaggatacaggccatccccgagcaagcgcagactgaattagaatatcaacagtgcatggttaaataagacaacagaggaaagaatggactaaatatttacagcaggtgtgaaggctgaagaggggagacaccctcaggcactaaaagaaattgtagcaagtctggattgtgaaacaccgggaaagaactaacgagatatgtcctaggagaaaacagcgatgttcacatcacacatggttcctgagtcctggataggatctggactaagaacaaagttggtcaccagaaaaatttcaagcaaggtacggttatccttagcactggagtttgagaaaatagtttggctgcaacacagaaaatgggatgcagcatggggagcgatgagaggaccccaagagcgtcaatgatggcaaatgatgatagacagtgaggggtgagaacctgaactgaggcacaacatggcatgtttgggaatatagctagagcaacagagaaaatttctgtgtgatgtattttggggaagagagggaggtgtgacagtatttgtaactggactatgtaagctcttcggaatgatccttaaacaatattttccgtaggccccttcattatcaaatcttatatctagttcaataatttggaagagatagtttgtacagcatttttttttttttttttttttttttttgctttaggtgcatcagtctttgaattgataccaaatcatagtgtttgcttcttttttttttttttttcttttctttaacggagtctcgctctgtcacacaggctggactgcagtgtcgcgatcttggctcactgcaacgtccacctcctggtttcaagtaattctcctgcttcagcctccccagtagttgggattccaggcgtgcaccaccattcccggctaatttttgtatttttagtagagatagggtttcatgatgttggccaggctggtctccaactcatgatctcaagtgatcatcccacctcggccttccaaagtgctaggattacaggcgtgagctaccgcatctggctgtagtgtttgtttctaagaaaatgtgttaaaatcgtctctgacatagagagaagggggtttgacacacatactgtatcattgtcaacagtatcttactcatcttctactctacctgaaggtgatatgaacctcaaataaaattgcaaaacttgtgtgaattttgtcaccataatttggaggcagtagtgacactcagtgtgtaagaagtcaagaatgcaaaatattccaagatagttcccccaaatgaaacatcgctggcataatcatgaaacatgcttacatttcttctataactaaaggacaaaagctaggtgaaacacacaaacctactgagtttggaccgtgctactttgacagttacttgtcaacccctaatgcctgataagggacttgtccaacacaggttctgtccacggccagccgtagccatgcatcaggataaacaaacatcagcctctttggtgggatcagctaaccacaggtctctcttgatcctcagcatggaaagcagaaagaccctcaccctcatttaatttctgaaacctctgcacagtagagctccctgagttaattaatattaaaaatagtatccccaaaatgccataatttattttactctaaggagaaattgtaaactttagtatcacagaggcagaatgaaacatttaaggcttgctaataatcatagtaataattgtatttccagtgcaatataccaggtaatttccatgaatcttattctttaattctcatggccaccctttgaggtaggaagtaggaagctcataatgtgaaaactgaggcttgatgagactaaattgatcacagtggcccagcaaacactgggggattcaaaaccaaatgtggtgtctggactcctgactgcacagatttgtgctatgccaggaccctgggcgcccagcccagcttcccaatggagagcccacaacaaacaagagctcttttctattataaaccatgcagcgttttgaactcactgtcggtttcagtgacagacgctcattcaaggcatcccaagcattaaatttaagtaaatccattcccatctctgttcaacaacctaaactccaagaactatctttaagcaaaggtgttctctatagatgtatttggcttgtgttgcattaggaacattttgctttcgtagagctgactctgtaaggatcatctttgtttggtagcctgaggtgtgacgttagcagtgtaccttgaacctcaaccaaatatctgcattttgtgtgtgtgctcttctgcttcacagaagttggtgatatcctatgtattcaacatcttcatgctagtgtgataatgtatcaaacttcacttctttgatattcccagacacttagaagtaaagtttctcctcttgaatgcaatataacatctctggatcaacctctgaacgtttctatatccctcacagcagaccttcaaaccatctggaaattcagttctgagtcacttctacaaacattgccaaaactgacagcttgattagaaagtggttaggttatgaaaaagatacttgcacacacatatttatagcagcacaatttgcaattgcaaaaatgtggaaccaacccaaatgcccatcaatcaatgagtggataaagaaacagtggtgtgtgtgtgtgtatgtatgtatatgtgtgtatatatatgtatatatgtatatatacgtgtgtatatatatgtatatatgtatatatacgtgtgtatatatgtatatatgtatatatacgtgtgtatatatatgtatatatgtatatatacgtgtgtatatatacgtgtatatatgtgtatatatacgtgtgtatatgtatatatatacgtgtatatacacgtatatatacgtgtatatatacgtgcatatatacgtgtatatatacgtgcatatatacgtgtatatatacgtgcatatatacgtgtatatatacgtgcatatatacgtgtatatatacgtgcatatatacgtgcatatatacgtgcatatatacgtgcatatatacatatacacgtatatatacgtgtatatatacgtgtatatatacaggtatatacacacgtatatacacgtatatacacgtgtatatatacacgtgtatatatgtacgtgtatatatacgtgtatatatacgtgtgtatatatacacgtatatatacacgtatatatatatatgatggactactactgaacgataataaggaatgaattaatggcattcgcagcaacctggatgagattggagactattattctaagtgaagtaacccaggaatgcaaagccaaacatcatatgttctcactcataagtgggagctaagctatgaggatgcaaaggcataagaatgataaaatggaccttggggactcggggaaagggtgtgaaggggatgaggaatagaagactacaaaatgaacgcagcatatactgcttgggttccccccaaaacctatggaaataaagaaaaggaaaggaagtagttaggttactaaaaaataccccacaaagaatttgctcttggcccctgcaagataataaagtgcaagcccatgaagaattctaaaagtaaaaccaatgcacttttgggactggtgtccagagaaaccaccctgaatttcctgggactcacttttcacctgcctctgctcttccaaagttgcagagagatcttttaagtctgtagtcagatgacaccaggtctcctccaaagctctgcagtgccttcttcctgcatcactctgcacaaacaggaagcccaacaggcagggcctcccttctgctccaaaccacctctgcccatttgtccctcactgccctgcccggcacactgggatcacatctccttttcgaagggctgattgccatcttccttcagggcattttcttcactgcctcctcctccatccatctctctatacccctctatcttgtgttaaattacccatcatcaaatcacattaatttttgggagtctcaggtgggaggatcactcgagccccagagttggaagttgcagtgagctatgatcacatcactgcactccggcctggacaacagagtgagatcctgtctcaaaaaaataataattttaaaaaattttcctccataaaacataacccctgtattagtctgtttttacactgctgataaagacatacccaagactgggcaatttataaaagaaaaaggtttaatggacttacagttccacatggctggagaggcctcacaatcatggcgaaggcaaggtggaacaagtcacgtcttacatgatggcagcaggcaaagagaaagcttgtgcagggcaactcccccttagaaaaccatcagacctcctgagccttattcactatcctgagaacagcacaggaaagacctgcccccatgatcaattacctcccaccagatccctgccacaacacgtgggattcaaaatgagaattaggtggggacacagccaaatcatatccagccccatgtgtgcgaggattttgtctcatttattcactaagcccttacctagaacaggacctgacacacagtggctctcaaaaatagtcttttaaatgaataaataaataaaatattttaatgaaaacattctgtgtagttaacatttgagacagatcaacatttgaaatataggtttggtgtatttggacgcatatgttattacagtgatgttttaatgaaagattgattctgaatattttgttttcctctgtagaccaaactgttattcattctgcttcataagtgagtgttaacattcattttagggaaagaatattcaaatagattctatttatttaaatactcagtagggaatgaagaatattatttgtattgtttatagcaaaaagcacatagttgaaaattaaactggtatttgcattttagtagtagcaattgcagataaaagatcggaggtatccagaagatgcaccgattaattgcagcatttgtgttgtcagcgtatctgtgtagccacgtgtatcccttaaaagatagcaaattaaatacctttcccttcatttgaaatgacattctttttctggtatttgaaattaaatttaagatcaattgaatatcctttagaaacactttacaaaaatgatgtttagttcagcaaaaagaagccacgtatttactttctaagttgtagagataaaaatattccttgtgtgtgtttttttaagggttcatttgtttttccattttcagaaattgaaaagggagggtgtggggatcctggaatccccgcctatgggaagcggacgggcagcagtttcctccatggagatacactcacctttgaatgcccggcggcctttgagctggtggggggagagagttatcacctgtcagcagaacaatcagtggtctggcaacaagcccagctgtgtatgtgagtattatgccttgacctggactccctcctgtcctgcaaggatcttgcaaggggagaaaaggagaaagacacagaccgcccatttagggagggcagctttcagaatggctcggggtgccacatttactggaaacgtgcaaggacgttctcgaacaccaacttgcctgctttcttcatttagtaaaaactaatttatagtttcattacatctactcgacaaaatgtacttgaacgtttcctaccagaaagggtcatcacatatatcgttgtttccatcaaaagccagtgatgatctgctgtatcagacatcagtacagcaacagagtcctttgtgacttaataatgctgtataacacttaaacacaagttgttcaccagtgcgagcatgggtggtggtattggtttggaattcagttgatgagctgcccacttcctcttaagaatactattttaacaagtagaaaaggcttcacagtcgattttaaaggagaggttttttttatttgtaaataactatagcaaaggctgaaaagtgtgtacaaaattatatggaataagaagcaaaaatgtattctagagataaatccaacagtttctccctccaaaaaattatttatataatatatatgattttaagtacacattcttaaaagtaaatttttcaaaatactttatattatccaactagaacatgatctgatgtttccaagttatttatttattcatgtttaccctgtaactaataaaaattttaaattactggagaaaatgcactcacaggaaagtataaaatataaatttaaaagttatgaaagagcaggctgaattgttcctatgatataggaatatacttttccatattaatatttgctcttctgaaggcagaaaattataactagaaattataatatttggcacacgttttcagtcaactggaaaggatcatttttgaaccacgcttgtgcttgattatgtataggttctggttgtgctctatatgataatgaaatattcgacttacaaattaggaaaggagaaaacattatggtccagaattacttatattaaaatagttggatcatcatagctatttgcaggcatgaattgcctttccaggttcttagctgtctgtttcacatggcaattctttggatatgtgcataactgtttgaaaatatatttgcatcttcacagtttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccagtaagtacgcccacacagtcaacacatccaagttctcattttacttacatgttcccattttgcttatatgtatgtgaagttgcatttcaaggttgatacttcagaggttttataatcattatgaaaatgacagtagtaaaattatagtgttatcctgaaaacttaaaaacaaatgtatcactgtatttagataggtggcttcatcactcctaaactaagaagctggatctcctctctctttcatctccttacatctctttctctccggttttccatttatccatccatccattcatccatccatcattctatccatccatgcacccaccaaaccattattccatctattcttccattcatccatccatctgtccatctgtatcctttcattcatccatccatcatttcatccatccatgcatctatccatcctttcttccatccatctttccatccatccttccatctatccatccatccttccatccattcatccttccatccatccatcgttccatcaatccattgtttatccatctttccatccatccattcatcattcatccatgtgtccatccattcatccattattccgtctatcattccttttatccttccatccatctatcaatccatatccttccattcatccttcccttccatcgttttgtccatttatctattatttcacccatccatccattcatccatatccttccattatccatccttccatctgtccatccatccatgcatgcatgcattcatccatccatccttccattcatctttccatccatccctccattcatctttctttccatccctccattcatccagccagccagccattcttcctttcttccttctattcttcctcccatctatacaaccatccacccacccactcagccacttatgcatctttcttgcaacaaagtagtgtagtaaaaacaactgtgtaatatgatgtcaggagccaaggattaaaatacagcactagtatgtaattagtgaagtttaatgacagctcattctctttgctttaggctcctcattttaaaacctattttatgtaagaatatctacttaaatgcactgtagatggaataaagtgagagaatattaatatgagtaatactacattatgatatgctaactgcctagtttcttaggcagaatacttagaattggacaataattgtttcatttagtgttatagtaactagaggatataaatttagtagtctctcattctgtaaataaagatagctaggcttagagcgtcagagtcatatgcccaatgtcagagtcctctgacatagtaagaaaaaaagtcaggattctaacgagagaaatcttgagcccagacactttctaccacccaccatatcagttctctctttgtctaagctcctatgaaaagtgcttttcaaaccctaaattgctgcataaatgatagttatatttgttcatctccctgctcgctctttctcactagacactgatatcctatttattaatgtattatctatctatgaatgatacaactgaaatttatataattatatacattatatgaatgctttataagcttgttctgttttcttcttttttaatacatgtaattaatactcaagtatttttattccttttttcttcttctttttctttcagcatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaaggtgcagtccctgccaccccccgctcttctcctttgaaatcacacatctatcttcaggcacacacacaaaccaacaaactgtgttagcttgctagggctgccctaacaaaataccacacacagtcacttaaccaacaggagtgtacagtctcccagttctggaggctggaagtctgagatccaggtgtcatcggcagggtggggtccttctggaactctgagggaggatctgcctcaggctggtcctccagctcctggcggtgtttggcaatctctggcattccatggctggagaagcctcaccctcatctctgcctccagactcaaaaggagctctccctgtgtgtgtgtctgtccctgtgtctaaattctccttgttaaaaggacacaatcatattggattgggggtccccttcttccagcaacaccttatcctaactaaattcatctgcaagtacccaatcttcaaatacagtcaccatctgaggcgctgagggttaggacctcaatgtatgattttttggggggacagaattcaacctataacagtgttgcttatggttaactattttgttgttcttgttacagccgacataaataccacctaattttcttcttcatatttctgttctggttacttatctaataaatatagagaggaaaatattttaaggaaaaagatgttgcctctaataattactcattttaaaaatgtttacttagagtatatgttcacagtccatatcagaatagtcagtgcgcaataagctaagaaaatatttttaaaaaacttaaaaacttacctctagtgtatatcaaagaagtacaaatttaagaagaaaagtaaaatatcatttttgtctatcttgttagcatagatttaaacaggtgaatgagacgtattattgaaaaggttatgtagaaactggcatttcctaatcatactattgattatataaaatcatggtattgtagtgtaaattcttagtaggactcttaaaattattcttgtcctttgagtcataagttatattcctggatcaatatcataaagaaataagcaactatacaggtttttttcaagaatgttttctgcaagactatttatagcagtgaagagttggaaatgattcagcttcaaacagcagaggactgattagataaatcatgaagaataacaggtatcaatacaaagatcataagctcaaagcgtctcaggtgtccttagcatgtgaaaaacagaggatgcaggcacatgtgtcataaatacatacatatctcatgataataactttgtaaaacactaaaaaaaggctacacaccaaaatgttaattatggttatgggtgatttttccctcttagtttatttttattttctcagttgtctttagtcaacatgtatttatttttaataagtgaatagaacaggaatatatgttaaatatcataaacagttgagaatttctgccctatctaaaatacctcggaataacattctcagacccatcatctctatcaaggactctaagcagagctggggtctaggtgtggagcattaaactcctccatgacaaccacagtatggtgggggcatgatccttcaccacctcatcctgccctggtcccacctccaaagaagttactcaccattactcaaagtagaaacgcaattttttttttttttttttttttgagatagcgtctggctctgtcacccaggctggagtgcagtggtgcaatctcagctcactgcaacctccgcctcccagattcaagcagttcttctgcctcagccttcctgagtaactgggactacagacacctgccaccacgcctggctaatttttgtatttttagtagaggggacgtttcaacatgttggccaggctggtctcaaactcctgacctcagaggagaagtagaaacttctaaccaggtcctgtttatagtatcgtctggtaatactacacgtaaaggagggtattctgatgttcacccttttcatacattgttaaaacaatttgtgggtggacaagaagcaccacccatgggtgaaatattgataaatagaagggcaacaaaaccctcttaatagctgaaatttcatttgtatgtatttccatcacatatggtaaatgtacagtttttatgttttatgctgtacaaaatgttaataaatgggtaggttttcatcttttataaatgagtaaatatatacacatgtggtgctcaaagatatgatactaatgatagggcacagttagtcacaggtgcaaatcgtattctagccaagcatatttcactgacttggaagcatgaattttcaggagaaagaagtttaaagtgaacactacactctcatctctgttctgtcctggccacaagtcaagctgtgccttatgtcctttaccataataggctgattgcagatatgttacaacctgcagggtgagtgtggaccacagcacaaacaggatgaggttaaaggcaaaacccagctataggttgttaacaaaggaagccctcggcagaaagaaaaagttaataggaaaagatgttaaaagtctacctgcgttgagaaacctaatgactgagtgcagctgagcctcagagaaggtaggggacgctccgatggaacaggcgggtaccccgatcactgcctctgctgaaaacaaatagaaagccaactttcagaagtaaatgcatctagtagggaaaaaaataaaatagcaatgaagcagtgagtaatacagataacaaacttgatttaagaaatgtttgaagaagctcacatcccttacagaatactcttatttattgtttttcttgaaaagtgttttgtttaaatcaattatataactgaccacaaagtgaaccttaacaaattaaaataagttataggtctcatgccctgtaatattccaattaaagtagaaacatgtaataaaaatagaactacaagcaaatgtctatccataaaaagtccactataattttacattaaagagaaactcaaaccttaatgcctatactatcccatctggaaaccattagaacagtactttctatgagaaacaatgtgagacagcaaaacctgtgtttcaaggaaaatgtctatctttaagtcctctaacgtagaacaaaatgatcaaaaaataaagaaatttaataataagattaaaaagttagaaaaaacaaaaataaattaggatcctattaataaaattcaagtgttataaacaatttaaagcaagagtgagttgttaatatcaataaaatagacaaactgtttatgattctgataaaaagaactaggaaagaaaaatgttatagatatttggtaacataaaagagaaattatccataccataaaaataatataactttacgtaaacagtgaaaagctcacaatagagcaatttttttatttaaaagcgtaggttatttatttattctggcagaattttctggatgccaggcacatgttgagtataaattttatggcctccgggcaaaaggtttctctttctctctttcttctgcttctaacaggctcgtattcctcaatgcagctcagtggcatcatgaaaatctcaagctattttggggaaaaatgactatacatgaaaacaccaactctgtggcagcaaagcttaaagtctgtagaaaacgggtgatttttttagcaaaagataaaataccaaaaatgactcacataaaaagtataaaatgtgcgtaaagtagcatagaaaagaattgaaaaaaaagattaaggattgaacattgaaaaagacacaagtaccctacaggggtgtgagtgagttctctttcaagtctagagaaccttagtgttgtgcactatcacagataatggagaagacaggctgcatccttcataacatttcatcaagccagcattaatgtaaccccaatgagattgttctaataaaaataaagccataggaaaatacacatatgtaatcaagaaggggtgtatgtgtgtgtgtgtattttagaaatacagtatcagggaattcatcactgtaatttaaatcatcaaaaaaaaaaagcaaagaagaaattgctttctaaacacctcattggctcattggtatatttgctttttttgttatcagctaagtgagtatgaacatgattgatgatgttcatcaaatatttttggtctccatcaggtggaatgtcttttcttgaatcttgtagattaaaggaaccttgtcatgggttctggtcaattaggtatatgaggaaatgctgtactcaacttctgggtcagcgtctttgattgctttcctaagacctttttccacctgccatagcaactgaagaagggacctgtgtctcacagacctagacatgccacatttgtgagaaattcacttccaactgtagctactacagttgcagggctgttagttacggcagtgtaatctaatccaaactgactaatacaaacttattacttactatttacttacttacaatctacttactgagatcattattattttagtgtaaattttgctcatcggcagtgttattattaaagtgtctatttcatcaggataaagcaattcaggttctaacatacactgtaaattacaaagtgatgggtaagagtataataaaataattaatatttggcaagttagacatattccaagaaacataaaaatgcaaaataaaattactaaagtaaaggaaacttttggttggttatgtatttatatggaaattcacacatagaaataacttatcatgcagattttagaaattgctcaactatcataatttttttggaattctgcatctgccatatgtctttcttatatagtatctttggatggttaaacatgacaaaataaaagttatatatttaacatatttaattttgcttatgttgtattcataaaagaatgtgttgcattgctttaaaaaacaaaagaattgaattacatataattatgtatatcgatatgtgattcataggctgcaaatgtgaatttaagaaattaacaagaaaaattaaaatattaataagtataattttggttgttttaaaaattatcacaaaaaatcaagtgttcttcaggagctcaagttaataaaaattaccctgctttcatatttttaaactacagaataatgcataggtataaaaataacaattgcaacttatttgggaaaaatatatatatataatatatcaaaaaatatgatctataaagcaatcccagtgctatccattattaacatgtttttaatttccactgccgtgttcactgaataaaatttttcttttattacatttataacagatggacaattttttatccacttttcaagtttaacattctattgcaaagattttcccatatcaacaaaatttccaaacgttacttcaaatatatttgccacattccaatatatggtcatgcagtttccataaatttttgcttttattttttctgtatttgtttcctgacgtaaattaagatactattggtaaatccataaatttcactaattcacattttttctagcatcaaaacatggctaaaatgatataaactttttgcatttttacattatacatatggccatttttaaataaaataaatattttttccaaaaggattttttcaccttggagtattttcacgtactttatttgatatctataaatccacaaagatgattgctaatggcaaataattttgagagagaatacataaaatctgaaagaaaacatgtggccagggacatattcttaattacggtatgaaatattggtatgctatttaaaattcctttagatgatacaggtatgcataatcactttcactgagcagtaattatataccctttcaaactttatttctcctttgcaattacaaatcactgtcacaaaaccttgcaaaaggttcaatgcagtctaattctacacttatcaaatttgattgaacattttgttttgtttcacactcacaaataatatgttgcatgtggctatttattttaataaaatgcacacaatggaagtaaataaacacatgcatacacacacctaagggtgtgtatatgtatccatcttgagatgtaaggtcattttacatttgcttatgtatagataattgttaaattccaaatgcatgtaaactatagataaccgggcatgtacgtaatgaaatggttagcagttaaatgagataattcagttagcacagagaactcacgtatacattaccattactagagaaaaagaactttgcttcaaggtaatggtaagtacatggaggtagcatatatagaccctgctttcaataaatgtacagtttccttgggaataagatttgctttgatacttgaaaatattcagtctatgaacacagaagcagattctggcttttatccgggtattgttatggcatatccttctgtctcattggatctaatagatattctacgtcttgttttagctccatgtggtggacatctgacagcgtccagcggagtcattttgcctcctggatggccaggatattataaggattctttacattgtgaatggataattgaagcaaaaccaggccactctatcaaaataacttttgacaggtaagaaaaaaattagtcttcatttggacccaatggtgtgtgtctcttccatagttttagtaaatggatcttaaactttaaaaagatggcagtttttttcggttcccgcataggagcacactttaccagaaacaggcacttacttgtaagttttgttcttcttcagtggtatcctctaagcccacagtgagccaatgctctggaggttagtaggggaactgccagtcctggaggaccattcccgaggtccgacccttgtatctgactctgggtttgggacctgcactggaatcaattcagcttgatgtctgattgcacatggaaaccactctgggtcccatggtcccttaggtgtcttctgtggtagaggaaatcagctctcctgttctggtggtggctgctggtcactcgagggcagctagtgatgctgagcgggcaatggggtgcggacagcagatcaatcaccaactaatcgcctatgagtgacattatcactagaatgttgcttggcttagctatttaataatgcatttcatgatctaaaaaataagcatgctgggctgcgtaggtatttgtttattaaaaaataagcaggctattggagttctatataagaagggttttcccatttctctcaacactgagaccaaattgatgattaaaaactaaaaagattttgtcatgagcaacatgaaccaaaggctagggaggcatctttgttgaaagtttcaaggttattctctgcataacattgggctttctctaacaatgaccttcttcttgactagactacattctggatttcagtatccggaatattatggtgtctcaagatagatgaacttcattgtattattatctttttgttttcaaatgatcaatgctaacatcaacacaggaaaggtttttcagcaggagttgtgttaactttcagtaattgtatttatttgaaataattatttttattttttcacttgcttctgacaaaataataataatccccaatagcacaatctcttagaacaagagaaaaaagttgtttataaatccatctatattagaaagtgaattactgtgtataatcaatcatttgaaaaaatactaactctgtaagtattcagttgattacgttgggtttcttactaatttctccacttactggtattggcaggcggagctgaagcacgccctgactcccagcagcgtatcaaatttaagtaatttagtaaaagtagtgatcctatattcttctctggccagtctattagccctctattttcagttgcctgaaggaagatatttgcttgatttttcccaatctcattcattcagtattgtttcagtgtgatgttttgctaaattccatttggaaatacccgatatttctgatatttttagacatgtgtgatctgtactctagacatagtacacagctcttaaaagatgaattgcataaggaaatgttcatttccaccatgaccgatgggctgacaccttaaaggatgggattgtgcgcacaaattctgagctctgtgctgatggtattgccaggcggtgtgtgttaggctgcccaacagcaaagaacatccagatgtttctgtttccaacgtcatcctggaaatcttccagctgttgaaataggcactttgtcagtcctcactgttactaaagaaacaggataggacaacttcagcatgactatgtcaaaggagattgctttcacgcttagccagacttcttgaatttgaactcaaacaactgagaaatcagttttaagaaaaagatttagaatagtgtcataagacaaagttggcactatgcaatcccaaatgtggcagcctgtggccttattctggtccagatgtgtgatatacaaatggttcaaattcctctttatggaagaatggggcccagggtaccacattcactagttgcaggaataggtaatcatgtgcatttgcactaatcagtgtatccatgatctaatgtatacaggacacagccctttggtttcaacatcgttttctgttgctacacgccatgaggctaagattgcttcccctctcccaagttttctcccaattcatcagcaacatccagcacagagctaatggcacaggcttccgtgggatcctttggctcaaagtgactgagtgagtcagagtcttatgacgcttaagctgctccctgagagccaagtcaggcactcagaaaccgggttagctcttcgaggatcagataggcccacttagaaaattatctccgtgcctggagtggtacctacattgcatcacaggggagccaagtggctgcaactttatatatatatataaaatctcaggctagattctcgggaagcataagaaaacttaagcagtttttggaagctgttgtaactttctcaagttattaaagtatcctttcatgtctgaaatggcaacatacccatggttgttctaatgtcttgaaagagttattgcaatttaaaaaggcacaggattttttttttcaggaaaggtgtttaaactcatcacacatttttaatgatcttctttgtttaagagatgatttcactctagtgcacccattttaagatgtctataattatgttaaatagggaatggtaaaaatagtttaaaaatatataattgagttttttctatttgggaataatctatttgtctatctatctatctatcaatctatcatctaagaaaactaatctggttcatagtatttttgtttaagctgaataaaggcctcctcttgtgtctgtaatattgtaagacagaatattagataagagaaagggatttaagctgtgccgtctcatcaagaaaagaacatactatccttatatttgtacccaagttttaagcatatgtaatttcaactattttcttcatgttaacgtacatgggtttctgattaaggaatgaggatgtcaggagcacgtctgtaagctggcagttctgcatgtcttttctgatgggatgtatatatttgcagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgagttgcaccttcccttgacagcccggcagggcagcatgcatgggagaactaaagatctgggttcttatttccagcctgcagatgactgtgctagtttactgatcctgcttgactctagcaaaaccatactatgcaattgtaagaactttctgttattcataagagagcatcttggaattactgccttttaactctcaaaaatacgtatccatcgcgtatgacaaagtaaaataataaaaacaatgaaatgggttcatcttctgcatagaataatggaagtaataatatacttctattattagaaaatgtactttctgagcaaaagtcttataggatatattactaaaattatgttaacctgggcaatggagaaaaggatccttgctagaaaaacagggttaggtcaatttgtggtaccgaatctgagtatagatagacacgtttcactgggtgaaagtcaggtaacaagaggcgaaggaattaaaacctgctaaaccttaccaaattccaaacaattgttaacagtctttcaacaagcatgaataatactttaaaacaattattaaacatattttaaaacaattgtcaaaatattataatggaatgtattttgcaaacagtccaaacttccacatggaaagttttcctgcccttgtttactgaaatcaaagttttagcttctgaaatgatgagattaagtaattgtattattttataataatatttatgcaaatatacttctgaaatctagctgatgggaatcacccctaggaatacatttttaacattagccaattaaaacaaaacaaagcaaagcagctgttattcttttctctgtttgaaaacacttccctcaaagagtagcacggaaaaagcgagaaaaagtggcaattactattggacctgaaggaatcagacttttattttgccaaagttttatggctgttctttttcagagctttatctcaagtactattgtaaagatgtttttaaaatttacatatacccacacgtatgattttacaaatgcatgcatagaatcatgtctactatgatgggtttcaaatctccttttgttcgttttcttgccttccattccccacatcacctcctattactcttgttaccctctccctgagccccactccagcacatttaaattaacaacctgttatgtgcattcctcggttttacatactcatataagtatacacaaacgtgcatatgcatgtatatcttaagattttgtctacttttagataaaaatattccaatatcaggaaaattgcttatcaatgacttaatgacaaatttcaaatttaattcagttattactcttcacatatatagatatacaacatttgctccaaagtaacgtattttgaaacttaaagtaaaatttaagaaccaggaaattttacattttgtttctttaaaatgtccattcgagttgtcacttctctttgaagtaacaatatgtgtaaacattgcagtgatctgaatttgtaagatccctaataagccttgtattttctcatcctctcccacacccctccccccaactttttctacaccagaatttcttgactcttagatatatagtgcatgaaacttcagagaataattattttcaggcattgacaaatattagaacacttttcctttcttttcatctgtatttctgtagctgtagatgactttgctttttctacttccatttgagggaatgtgttccaaaggctaagtgaaggcagaagaaactaatttcatttgtttatccaagtcatttaaataaatgtcttcttcttatttctctttctggaaaatcaggaaatgataaaaagtcatttcataaatttctatttagcttgtcatcctcactaatattataataataatattttattattataaaatatggaatacacattatattatactataatataataatttaatatgtaagtaatcctgacaactatttttataatcttaaaagaatgactaccctatgttttggtattcttttcatttatcctgtgtttaaaagtagagggcaggcttcgtaaggcattcttccatcacctggagtacccctcagagagtaaagctctttgccatttttctttttttctatatatatatatatatatatatatatatatatatatatatataatttatttttttattattattattattatacgttaagttctagggtacatgtgcacaacgtgcaggtttgttacatatgtatacatgtgccatgttggtgtgctgcacccattaactcgtcatttacattaggtatatctcctaatgctatccctgccccctccccacaccccacaacaggccccagagtgtgatgttccccttcctgtgtccatgtgttctcattgttcaattcccacctatgagtgagaacatgtggtgtttggttttttgtctttgccatagtttgctgagaatgatggtttccagcttcatccatgtccctacaaaagacatgaactcatcaatttttatggttgcatactattccattgtgtatatgtgccatattttctcaatccagtctatcatttttaggcatttgggttgtttccaagtctttgctattgtgaaagtgggtgaaggatatgaacagacacttctcaaaagaagacatttatgcagccaacagacacatgaaaaaaatgccatttttctttctctccatccctaaaaagaagaagaaaactgtcaccaagatgatgcctgtttatacagtgataattgtgtgagagtcataaagttctgatctgctggagagtctagcattccctcttctttccaccttgttggaagtctcaggaggtagctgtatagccacagaagtgagcagaggcctcacctagtgagtgaagacaggaaattgttgcgtttggaactttccagcactgtgacttcaaaggctcactgctctaaacacacatctagacttgcatatagtgaacttccagaaggctctcaaaggtttgtcacctattcctctgacttaagggagaaataggacctcagaaggatgtgatactgaaccttgacttgggatcacttcttatttatgtatcagtcgctgtgtatttgaagagacatatggaaatgtacataagtgaatgaggttcaggacatggctttttgtttgcttgttgtaagaaaatgagtcaggaaaggcctgggattttatgagtgcttatcaccagccctgcacctaagggttacctgcggggtttaaaataaaaccaatgcctgaataccagctcagatgttctggttgctatttctgtgggtggtgtagagatatgagtgctttcagaggctcgcaacccactcagagggtgtccccgtttacccggtgctgaaggggaaggtttcttcaaacatcatagtgcactaacacatccctgggagcttagtaaattgtacagccccaagcccagattccaaatattgtgattcagggaactcatgatgaaaatcagaatcctgagcttttaatcaagtcctcgaggtgattctgaataaggtgaaggcagacgcagatcccgggctccagggagagagaaaacccacaggcaagcaggagggaaggggccaaggccagcagaggtcacggagggttaaaggaaccaatgagtccagcgagaaaagcagagacagagaaaaagtggcaaagcgtggaagagaaaaatgctaccaaccccttcatccaggtaaccccgtctagcacccttcgacaaaataggttctgaagccaagatgcaggcactagaaaatgattacactcactcatccaacacattctttgaaagtgggttgcctgtgacccaagaattattattttttttcaagtgaaaatgtcatccaatttttatttattttatttttttattatactttaagttttagggtacatgtgacaacgtgcaggttagttacatatgtatacatgtgccatgttgatgtggtgcacccattaactcatcatttaacattaggtatatctcctaatgctatccctcccccctccccccaccgcacaacaggccctggtgtgtgatgttccccttcctggatccatttgttctcattgttcaattcccacctatgagtgagaacatgaggtgtttggttttttgtctttgtgatagtttgctgagaatgatggtttccagcttcatccatgacccaagaatgatttatatcaaactctttatgcctcttaaaaacaggaatattgctcatctcttctgtttcatcatacatgtttcacattataaacactccttgctttctgaaattattaatgacgcttcttcatgcccatagaggcccatgccaatgatctctacagacaaaatgtgttgcagaaatcacagccacaggtactcgaggctgacttatatttgcagcggtgctacaaggcaatgtgagctactgtaaacagcattcactccagaaggcctttctgaattgtgtggctcaaaggttgaagtcatttttttgaggcttttgtaaaagcaaacctagaattgcagttctgcttcatgcactcagtcttaggaatcatctcatatgttagtgtccagcgacagtctagccattctttacgaggaatgtggcacagtgtctgtatataatagcgattgcattctcgctccagaatgatcatctgctttgtatgttgatctttaaatcaccactttaaaattgtcataattttgtaagaaattggaaaataaatggaattctcaagggtatgaaggttttccatttaattttagagcattttttgaaaatgctgtcaaaagtatcttgttaatcatctctgaaggcagaagaaagattcatcacttgtaaatgtacatactctactgtgtgattgatatatcatgttattcatggaagaaacattgtgataaaggagtatatttagtggtttatatgtgcgtgcacaccacaccaattgtttgctgagattcggtgactttttatatgatcagaaaaggaaaggagagtggtcgggatgtaatggtactggatgcaatgcaaaggtatatataacatgcccatgcatgctaacactcacaggcacacgcatggatgcatacatgagagagaggagaaaagcaggcaaaggctcaggtttcaatatcagtaaataatgtaacatggccagtttgcttaatttcttggctcactggctttatcaactgtgacttttcaacctctattttgaaacctctcggaggctgtgagaagtgacatctctaagctcggcatatgaaatgtgctcaggaaatgttcattccttccttggactaggagttttataaagactgttgattcatacagaaccctgctcatatcaaatgtacctccgtatgagctgcacacggattatttgcaaagtaatcaactccctttattcattaagtagcaaatgtattcagtcacttattttgcaaagaccaattgaaaaaaaaaaagtaatgtttgtaactatttgtatcaaaaattcattgttgctttaaggttcaagtaagaaggagtgggaacagactctgaatatacacgtcgtttcaacaaagtccggtggtctgtatttctctttgtgctgtcaggcaggagacagaatgggaaagaaggtaggactttgccctacctttcccacaaggtaaattggctacctgtgtccacagactggtcttagtttatcataaatgtattgttccattggagataaatcacctgctacaaaattcctttttttttttttttttttttttttgagacagagtcttgctctgtcgcccaggctggaatgcaacggcacaaccttggctcactgcatcctctgcctcctgagttcaagcgtttctcctgactcagcctcccaagtagctgggattccaggtgcccaccaccacacctggctaatttttatatttttagcagagacaggttttcatcaggttggccaggctggtctcaaactcctgacatcaggtgatccacccacctcggcctcccaaagtgctgggattacaagcatgagccaccgtgcccagccaaattccagatgttctttctcaccattttcttgtttcaggattcttttacatggccagtttcagttgaactggaaatcgaatgtagtatcataattctaccactcaacagtcctcccgtcctgtactctccattcaaacagtttgtaatgaaaacgagaacaatgtctgcatatttcaaaattcaatagtggtgtcaattattatttaaaaatgaatggaagtattatggcataatattggaactaagcatcaattgtgaccttaagagtttattcagtttgaaatgtaaataattcaacattttaattcgatgtttttatttctaccgcagtttgtctcttttcactgtaaattttgtgtgggaaaagtttagtttatggtttataaatttcattattaaaaccattaatatataatcctcacttattaaaaccattaatatataatcctcacttattctaagataatcgttcctattactgttttgccgtagtgcatacactgttgtttagtgaccacagaaacctttttgaagaaatgaaattatttagttaactgttttttttccccagaaacctagagatcagtgcatttcttcagcagagcttcttcttttgagggaattcttgtcttgattttgatcttgatgctaggagctggatgtcattatccttagcaaactaatgcagcaacaggcaaccaaacgccgcatgttctcacttataagtgggagctaaatgatgaaaacacatggacacatagagggaacaacacacactggggcctatcagagggttgagggtagcaggaaggagaggatcgggaaaaacaactaatgggcactaggcttaatacttgggtgaggaaataatctgtacaacaaactcccatgacaaaagtttaccaatgtaacaaacctgcacatgtacccctgaacttaaaataaaagtaaacaaacaacaacaacaaaaaatcattcacccagcactgggttttaaaataaaagtaaacaacaacaacaaaaatcattcacccagcattgggtaccatgtgttcatttggagccaataatgcataaaatctgtgggagtgtcctggaagaagtcataaacaatgcctctgaaagtgaatgtgtgtgtgtgtgtgtgtgtgtgtgtgtgtgtgtgtgtgtgtgtatgcatgtgtgtggtgtgtatgtagagagagggagggaggagcaggtggtaggtaatagatttctagccaaatgatatccacgttgcctctggcagattgaaagctcctccagagttggaaggaggctttcctgccatactgcgcagcagcaaggacagttacattctgttgtttagggcaatagacatgtgttagtgtttagaaaatttgttagaaaaacagtttaagaaaaaagtattggggccaggcccaagttatagcactcaaattttggaaaaataaaacatatgcaatgatcagaaacaatatcccgaagatcacctttagagactaaacagtctttaaattagaaatatttttaagacttttaattcacagttcagatattcattctaatgttctgatgtttactgagaggatgacacagcaataacaaggattttttatttcttcgcatatgtaaacattacaatgatattcttttcccttattctcattttccttagctcttaaaatatatgtttttctaaaaagagaaatgagaaatgtgagaggagaaaagaaactctcataatgatatgatcataattacttcatgcacattaatttttcccatcgttagcaaaggctaatagtagctatcttgcaagtggctgacttaaactaaaatttgaaaatagcatggatttatggaatgcaaacttagaaaaataacactagcacagtttttaattgcattatatgtgtatatgtttgggtgtatgtatgcatttatttgaaagttaaactgccaaaatctaactggaatatataaatatagaagtacatatgtctatatttaatacatatataagacacagggagagtggtggtgaaaaatagaaaacaggaaaagtcttagactttatttagtgcaattcattgattttccaagaagaaaagtaaaattcagagaagttaattaattattcaaggttgttgtatgtagataatatctggtaaacagcataacaatataaatctctcttttaaaaaacgaggtcaaatgtttgaagatgcattggcttttatgtccatggattgttgggttcacttgcataatgtttcaggtcttattatttctgagactatttcgtagttgatggcgtgggtctctattattttcaatcaaccagaaagatcctcatcgactgcattcgttctgtgcatccaggtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacggtaggtacagctcagtgaggcaatgcaccagcagggtgtgcagagacagcgcacacgtctaactagctgggtggtgtgtgtatttcagggggtggtaccttacgactggcgtgagttccctctgagaagttgtataccatcatcgtatcattcccgatcatttgaagtttacctaccaccgtgtatgtactagatagaacaactgtccttcaactttatccccgaatgaacaaacttagggagcttagttctgcacatgtgttttacatatggtatttattgaaactggcacgtggggcggtatagtcgccacacatatcctaggatgtcagacctgattttcccctgacatacgtcccagtgtctcacttcctctcagtctacagtccgtgtctttgtttccgtggactgaatgtctagcagagccttctcctgggagttctcattctgagctcagaagctgtcaggagatcttcagcagctttttgtgataacagccactcctgttgtcctacacaaatcttctcttgggaatctcaagacaaataacattcctgattattttgtgttattgtattgctcaacgttatactatgctgtgtgtagttataataacagttaggtaaatatgttgcttgtaatcatttgccaaaaaaacttggggtattttgcccttgaccatgaatataaccccagtataacattgtttctatggaaaataacattccaagaaacattgtttctgcagaaaaacgttccaggaaacattgtttctatggaaaacagtgttccaaaacacattgtttctatggaaaaagcaaaaatatttcatttacatcttcaatacttttcacagacaaaggtatttcctttcaaacatgatgcatgcattcattaaacaccttgacttctttaaaatgagcacccaaaataacagggtttatggaaaaattctgcttaactgcagatcactcaaaatctttgacctttgtcaccaaagcacgaacccacacagtaactggcactgtggccgagaccacagagtgcaggtggacagcacagagctgctggagccctctcaggaagtgtgggaagtgtgcgaaccagctggaaccggtgggaatgctgcactctgggcaggagtaggtgggagtcgagttcggcgtctgtggggccacacgagcaggctgagaaagaggtgcagcctgacatgagccactggccaagcaacgcaggggtgagccccccaggtgaaggtgctttctgctaagtttctgaatagagatgcaaaagggttccttttttgtgcagatgagctgaggcatttttcttttcctgctattggttataattctaatacatcaactccatttgtctagggaatatggtgtaagcaccaaggtaatttagacattgtattgatatcattttgccacttaccaatcttaaatgagctaagaattactattgcagcaggaaagacagtaagaatttagacaattgctaaaatgtacattcttaattcctcttctatttcacgacaatcacagatggtggcagaaattacctagtgctttttttttcctctcatatgtgaatctgcaacatggactatgcatacccagccctggcattttcccacagaggaattctctggccaacttcttcttatccaagcagatgaaagaggtgaaaacctgtgaacagtagttatgcctaagtttttctggaaagacatgtctcatttttttacattaaactttaagtaaactctaaaataaatatttaaacataaactctaaaataatatatcgctttcataaatatacagagaaccgtcatataagtgaatttgcctacagaaaacaccataattaatagtaaactcttataaaattcccttgaaagtcaagaacaggatatactccttggttttagaagtattgtgtaacattgctttgaagatcctaacaaatgcaaaagtatatgaaaatgatatgaattagaaatattataaagagaagatagttgacttttagcaacaatcagttcagtaggtggctgcattcaggataacaggtcaatagatttccgcataggatataacttattagaaatacaataaaaacatgtagggtaaaacacaaaaacacaaaaaaattatccaggaataatatatctagcaagaaatgtaaaggcctatatacatacatacatatatattcatacatacacatgtatacatacatatgcattcatagatatgcatgtatatgtatatgattttacatttctatttatatatttagacttctatatatttatatattatgtattatatatttatatattatgtattatatatttatatattatatatatttttatttatatatatattttatatataaattatatatatatttatatattatatattatatatttatatattatatatattatatttatatattatatatttatatataaatagcatatgtattatatatgctatatatgcatatatattatatattatatatgcatatattatatattatattagcatatgtaatatataagcatatataatatatattatatatttgcatatataatatatatttacatataaatagcatatataaatatgtatactattttatttaattatatatttatatataaatagcatatattaatatatattatataaatatatatttatataatttatataaatatatatttatataatatatataaatattataaatatatttatatataatttatataaatatatatttatatataaatagcatctatattaatttatatgtatatagcaatatataaatagcaatttgcaaatatttaaaaattaatttggaaaagaaatgctccaaatggatacgaaatatatttttgagaataataaggaaggactgtcccatgttgtatcagagcatatgaaaaactaatgataaaccgaacaatgtggaattggtatggaaatacacaaatatattagtgcaatagcgtaaggattctagtaacagatctttgtctgtacagaaacttaatttataatataattattccattttgtagaaaagggatatcctattaagacatagtgttgctcaaattggatgcctgatttgatttaaaaatgtttaaaaatgtacatgaaataagttacacattgattgaagatataaagattcaaaacttaaaattattatgtgaaaatttagactatctctcagacaaccattttttaaagatgtctacatatttatttatttctacaagtataagtgtgtagctcaatgcatttcccagagtaaacatgtccctgtcagctcaagaccatgtaggtcactaaacgaacttttccaggactccacacttcgctttcacagcctcgcccagtcactgcctcccagggttgaaccttaattgtctggcactagtggttatgtaaataaatgaaattatccagggaaggtcctgtttgtccagcttctttcctgcaaccttaagtctgtggggtccatccatattatggcagttagctgtgtttcgctgcttctcatcatctaatattattgcttaaacatatcaaaagtttttatttcattctactgtttgctgacatttcagttgttctgagcacatttttgtatatttattggacattgatgtatcatctcttataaagcatctctttctttgcttccatttctattgggtcacatgcgtttatcttactgaattataggtgttgtgtaaatatttagatacagttccttcgatctacacattgtaagtcttttattctggagttgttcttctccttctcttattggcatcatttcgatgaatagaaatttttaattttaagatagtcccatatttcactgttttcattcgtgcatgaggttttcctagtgtggaagaaggcttccctccatgcatgaggttttcctagtgtggaagaaggcttccctccatgcatgaggtttttctagtgtggaagaaggcttccctccatgcatgaggtttttctagtgtggaagaaggcttccctccatgcatgaggttttcctagtgtggaagaaggcttccctccgttcagagtaatgaagacattctgttgttctctcctaaaaactttaaacattttaacagctttattgaggtgtgactgaaatgcagtaaactgcatgtttaatgtgaacaatttgatgcgatttgtgatacatatgaacatctatgaaagcatcaccatgatctataacttgttaatcacccctaaaagtaaaaacttatgtttatcttttaaatttataacttcaatccatctaaaaatttgtggatttgtggtaaggaacgatgtagtgtccagatccatttcttctccaatctggctatctacatgcgctggcatcattggtatttgagatcctgtttctcctctcattgttcggctgactttgtcacagcgtttaagtggccatgcctgtgagcatcatgttttctttgtcatttagttttgggtttttttgagaaatcttagtttttaaatcttggaaaactaaagaaatccagaaacagtaaatgaaaaaacattgatcaattttgctatatgcacactaaaagttattctattaaagatgtaaaataaagggtcagacaaccaaaaatagttgcattctccatgtaatatacacatgaaataatcatactctgctactggaagagagaagaaatgcaacactaataagccaacagatctatgagaaaatgagctatgcagatacattttatatctatctctatatagagagagatatttatatttatatttattattatatattatatagagatatttatatatctattatagatatatatagagaaagacataatgctaataataaatatatatttatataaatttatatatatataaatttatatacataactaattaaatatatagattatatataatatattatatatattatattatatatgttattatataatatattatgtgttatatattatataataacatatatataactaattactaaagttattggaatgctaataataaatatacatatataaatttatatatatatataaataaccctaacccaataaactttaaaaaatattccagtgctgactaggaatcagaagaatgcaaataaataataactttttccctttcctgctggagcacagtgacaggatctcggctcactaaaacctccgcctcccaggttcaagcgattaccctgcctcagcctcccgagcagccgggattacaggctcccaccaccatgcccagctaatttttgtattttttagtagagacagggttttgccatgttggccaggctggtctcgaactcctgacctcaggtaatctgcctgcctcggcctcccaaagtgctgggattatagatgtgagccaccgcgcccagcctgatacattctttttaaaggaaaaaataagaggtaatagaacaatgcatgttgtgtatatgcatatactgtatagatatatgtaattgcaggtacacacagaattgcatagaaattgactgaaaatagacattctaaaattgtaactctcatgctcgcctcttcagagataactaggctgtagcgtgggagcagtgagattttttatttttcactctacattttttggtattatttgaatttatgttactgagtcttatttttgtaattggaactctagtaatgaaaaataaataaactacatgtgtctgtataatttttagtgtcagaaggatgataactactggctaattataattttgtaaaactcaaggatgtcatatagacgatgcaaatatttgtcatatttttgggttctatattaaaaatatttgcaataagaatgataacccttaaaatattcaagttttcttcatgtgtaactgaacttgaatctgtttgatgttttattaaattaccctaaatttgcaatagaataagttaattgtatcaataattttacttgaatgtttatgtgccatgcaaacacatatggctttcttggatgatactgtgcatttttaataatttatttttgttaatttggactatagacaaaaatagaattttaacatagggtgtgtgtaagctgctctcttttttttttcatgtgggtagatctgttgaacaggtaccgacatggggcttgtcaagttgttttacttgcagtcattttagtcatacctgtaaagattgaaaagttgtagtactctgaatgtaaggtgatgggtgaacgcaccctgttcatcatagcacagtcattgaattacgtatgctcttgatctggtaatgaaaactgatatacccaagcaagagactttgcctgactcatttgagatacataattttgattgtaagtgaggtttttctcaaaacaaccttctcacatacctgtgcattcaagtaccatccccaaattcttctttgagcattggtaacttactttttaaaatattttactatctaaccaaaacttttttttttttcattatactttaagttctgggacacatgtgcggatcgtgcaggtttgttacataggtatacacacgccatggtgttttgctgcacccaacaacccatcatctacattaggtatttcttctaatgctatgcctcccctagccctgcattctccgaacaggacccagtgtgtgatgtttccccagcctgtgtccatgtgttctcattgttcagctccctcttatgagtgagaacatgtggtgtttggttttgtattcctatgttagtctaccgacagtgatggtttccagattcatccatgtccctgcaaaggacatgaactcatccttttttatggctgcgtagtattccatgatgtatatgtgccacattgtctttatccagcctatcattgatggacatttgggtttgttccaagtccttgctattgtgaacagggctgcaataaacatatgtgtgtatatgtcttcatagtagaatgatttataatcctttgggtacatacccagtaatgggatttctgagtcaaatggtatttctggttctagatccttgaggaatcaccacactgtcttccacaatggttgaactaatttacactcccaccaacagtgtaaaagtgttcctgtttctccacagcctctccagcatctgttgtttcctgactttttagtgatcccctttctaacggttgtgagactgtgtctcactgtggtttcgatgtgcatttctctaatgaccagtgatgatgagctttttttcttatgtttgttggctgcataaatgtcttctttagagaagtgtctgttcatatccttcacccactttttgatggggttgttttttgttgtaaatttgttcaagttctttgtagattctgggtattagccctttgtcagatggatagattgcaaaatttttctcccattctgtaggttgcctgttcactctgaggtactttcttttgcagtgcagaagctctttaattatatcccatttgtctattttggattctgttgccattgctttttggtgttttagtcatgaagtccttgcccatgcctatgtcctgaattgtattgcttatgttttcttctagggtttttatggttttaggtcttatgtttaagtctttaatccatcttgagttaatttttgtataaagtgtaaggaaggggtccagtttcagttttctgcatatggctagccagttttcccaacaccatttattaaatacggaatcctttccccattgcttgtttttatcacatttgtcaaaggtcagttggttgtagatatgtggtgttatttcagagacctctgttctgttccattggtctatatatctgctttggtaccagtaccttgctgtttttgttactgtagcctggtagtatagttcgaagtcaggtagcacgatgcctccaactatgttcttttggcttaggattcatttggctatatgggctcttttttggttccatatgacattttaagtagttttttctaattcaatgaagaaagtcaatggtagcttgatggggatagcaataaatctataaattactttggacagtattgccattttcacaatattcatttttcctatccatgagcatggaatgtttttttatttgtttgtgtcctctcttatttccttgagcagtggtttgtagttctccttgaagagatccttcacatcccttgtaagttgtattcctcagcattttattctctttgtagcaattgtgaatgggagttcattcttgatttggctctctgtttgtctattatttatgtataggaatgcttgtgcttttcgcacattgatattgtatcctgagacattgctgaagttgtttatcagcttaaggagattttgagatgagaaaatggggttttctaaatatacaatcatgtcatctccaaacagagacaatttgacttcatctcttcctatttgaatgcgttttctttctttctcttgcctgagtaccctggccagaacttccaatactgtgttgaataggagtggtgagaaagggcatccttgtcttttgccagttttcaaagggaatgcttccagcttttgcccattcagcatgatattggctgtgggtttgtcataaatagcttattattttgagatatgttccatcactacctagtttattgagagtttttagcatgaaggggtgttgaagtttattgaaggccttttcttcatctcttgagataatcatgtggtttttgtcattggttctgtttaagtgatggattacgtttattgatttgcatatatggaactagccttgcatcccagggataaagctgacttgatcatggtggataggctttttgatgtgctgctggaattggtttgccagcattttatggaggattttcacatcggtgttcttcagggatattggcctgaaattttctttttttgctgtgcctttgccaggttttggtatcaggatgatgctgccctcataaaatgagttagggaggagtccctcttttttattgtctggaatagtttcagaaggaatggtaccagctcctctttgtacttctgggagaattcgactgtgaatccacctggtcctgggcttcttttagttggtaggctattaattactgcttcaatttcagaacttgtttttggtctattcagggattcgacttcttcctggtttagccaagactattttctactctacccagcaggtgacctagaaaataaaacttattaattgaatgtcttcctctcttcttaccaacaatcaaacacatccaatattcaatacccttcttcatccttacatgttgcattatttaaatcattttcaacctccaagaccaggtcacactcagccttgatgagcattcctctggaattgctccaggccatgacggcactgacttttctgacctcaattcttttaatattcagctccataaagttagatagaaagagagagagagataatataacatgtgtttacaacttatattgaatatatcttagactaatacattttacatactcaatacagtcagttcagtttgattttaagctcccagggggtagtaactgaggaaacattcatggaaagtacagcccttaacctggtgtttccgttttgggtaggatttcccaaagtagccagcatgtgaacaggcatcccaggatatgagcagaattaccaggagttgataggtgcggtacagtaagaattcctggaggtttagcaaagtaggtttaatggaaactgagtgaaggatcaataggaaaatgatttaggagaaacggagtgggaatagaccaaaaagagccaataggttttgcagtacaggaattgagatgctatagggatgccagttatatgggtggcattttccatagaaaataaaagtacacttagcttattcattttgtttctttattgtctgtcgatataaatgtatgtaaatttgagatttaaacctttcgaaggaatcaatagcatgactgtaatttgcagcactggaacatgtttctcagtataaagaatttgtggtaaaaatctattaataagccaggcatggtggctcatgcctgtaatcctagcacattgggaggctgaggtagatagattgctgaggcccaggagttcgaggccagcctgggcaacacagtaaaaccccatttccacacaaaaaaacacaaaaattagctgggggtattggcatgtgcctatagtcccagcggttcaggacgctgaggcagggggatcacttgagcccaggtggtcaaggctgcagagagccaagatcacaccactacactacagcctggacaatagagcaagactctgtctccacaaagaaagagctattactaaatctacaaattttgggtgatgttagagtttgatatgggagtttcagtcagtcatgtttgatagttttcatccaaccataaggcttgttctcattacccttcaaatcttaagcaatctcttaaaccccatgggtttttcgtgcaacaaaagttacataagtaggatatttaaacctttaaacattcatagctttcagaaaagaaaaaaaaataattataatattgtatatcaacatgaaacacgataaactcagtgtctgtgctgggtgcatagcatcagttcagtgtgtttttaacattactctttcacacattcaaatgttaaagaagtgaacattgggataaattgtcctctaattttgtgaaagacaaacgcaaagaaaactttgaaattttttttaattaaagaaagatagttttaacaacaaaaaaagaatttatttggaatcatgcaagtagttcaactgcacatttttcacggagaatgggaggtaacatgataaatatgaatattttatatttaacattgtaaattttaattatcttttttattatgaataagatatatgttctgtagaaaaatttattaatagaaagctttaaaaacaagtctgtgtcaccatgagatataatcaatgctttccttcccaattcaaatatgttttcagacaaatttgttgttcttggcatttgaaaaagtattattggttacccttttcatccatacttgcaggcaattagtttactctttatttcttaatatttcaatagtaattatgttattaaaatatttttatattgtcaaaaaattttttttattaaataagtatttttgaaaactgtttactctctccacaagcatttattgagaacctgctgtatttgcaatcacacagaagtttaaaatctatcagcatagcaaaaggaaagacatttttaaaaatcacacaatgaagtaagtgctttattagacacagaaaagtggatgaggataaagaagttggagaaaaaaagttccaatttgggatatcgaaagcttggaggcaattttggagatacatctttaagatggaggttgagagggagggacatgtttcaacgtgaagaaatggttataaactgaggtgcaaagagaaaaaaagaggtctggaggattgaggggtgtgaatcactgaaggtagatgatgatcaaatgcctcgagtgctggtctatggccataggcagagattcatgctgcagtgtccagcgatcacactgtgaggaccccagggtttttctgagggtgagatgggggctggtcatcaggattggaatctctcctatgcagctggactgccccaatttactcccctccttcctactgggggtttctgcacaagattccttttggtggaaagtttctattataaataaatatgtgaacaacatatttattcataaaaatatatataatgtattcatataaatatatgaataaaatcagcgacttctgtagggcatggagagtctatgaatattattgaagtggaaagtaactcattaagtctgacttcaaatagaactgtatttgtggtttcaggagaacaagaaaatgatggaaaaaaagagaaaagatggaaacagatcaggcccaaggctgtgctttcacaggtggatctctttgaggaagaggcagacttgcagaggctaggcaattgataagacaaaaataacctgaaacacaccagttgaagaaagcaatagtggggagtagttagaagtgtcactaggaggatacaggagtttaggagagagaggtgactccaaggtgacatcccgagaaacctggcaagcagttggaagttcaacacagttggagaacgaggtcagtgtttaacatgtacatgtggaagctgtcaggtttcaagttacagttgggcaccgtggaggtgaatgccaccgtccagggagctagcaggtgtatcatcaccagctcctctttttcccactgccgtctctaacacggagatcactgttgcctgtgaaattgtctgcgtgcttcaactgccgccctcctcccatccataaacttgttgaattcaatttctgagttccaggcaacaataactgactctgcaaacttccatttattagaagactttggcagggtctggggaagtgatggggtggtgcgggtggtgggaagacaataaataactaaagaatccccagagggctgtgtgctttgccatgaacatcagtaggaagccgtaggatcctggaatgagttggcagagaaacctcagcagacagcctgtctcggggcaccctgctaccatagggttgcttctgatcttctgcatttcctccgaccttgtatcacttactccatactcaccatcctgggagtggacatttgccaggatgtgcattcatcactttgttgattcaccagcatgtccgtcatagtctaatcatctagacctcctttgagtttagagagcaacttaatattcttgttcttagaataaatcagacctcgttatctggagttttaaaaccaagttatttgccttccccattagaatgtaaactttggaaaaacagggacttttctgtcttattcattgttctatgcccagaagcatcaatgagtgtttggaaaacattagtatgtttcttaataagtaactctaaatgcaggatgggatagatgaatggataaaagtagaggacaaaagacagaacttgaaaaacgggtggatgggtcggacatggtggctcacgcctgtaatctcagcacattgggaggctgaggcggggcaggtagatgacttgaggtcaggagttcgagactagccgggacaacaaggtgaaaccccgtctctactaaaaatacaaaaaattagctggctgtggtgatacatgtgtgtaatcccagctattgaggaggctgagggaggagaattgcttgaacccgggaggcagaggttgcagtgagccaagatctcaccactgcactccagcctgggcaaagaagcaagtctccatctcaaaaaaaaaaaaaaaaaatagttggatgctttacttcaactcagccaggaaaatatcacaacgtatgtctcctcttttgttcttcaatgatttctgcatatcttagtcctccatccaaaagatttctaatgtaacatacctgcatccttggtgttggctgggttacataaatagaaaagtaaaattcaagaaattatagcattaaggacagcaacagtaaaattttactgtgtcttttacagctactcagaaaaggatctaccgtgcatgaagaaacagattaacataattcaaattatgagcagctatatttgtagctctgctaagggaatgtagacatgtctacatatgaatacagccctcacctgtatagacactaaaatgtaattcaggtatttcatttcattctctcatctcctcacttcaattttaggtgagaataccaattcaattctccatacatcaaatttccttctcctgaaaaatattataggatttgtggacagaattacttttatgtaaagtcttcatgataactgaattggactacgttgtgtttgcacccatataaatctaaacaagcctgagagcagctttatctctaactttctgtctgactttctcctgatggcagcatgacggggctggtcagtgatttccgggttctgtgtgtggtatggagggaaaacatcaaaaagagggcagagcacattccctcccagatttttccccaataaatgatcaagtaacttttcctgatgatatgaagacagaggataaaataaagattgattgtttttatactgttaaacatagttggatatgaattaattttatcagtttatataacatgcagattttgggataaagaccactgacaagtagctttggatataagatatctcagttttacataaaatgttttacattcattatggtgatcgtcttcataaaaatttgagaaattattgcatcaattcataccaatccaatcatagaccagtgaaaagttacgaatccaaaccttctgaattcgggactcctccgtcctctgctggttttcttcccactacgcggtgcgctggcattagttccctctatggaagcttatttctacattcactgccactggtgttctcacatagttgtggtctcccttctatcccttgctcaaccctcttccatggcctccagacctatgtaacctgttataatgtcggccattctacaggcaagcccagcagacttggagctttggtatccaaagctgaacgcctgccttacactcatgacctggttctcctgagatctccttcacctgtagttatttcacactcaggttatgaactcacaatcacccccagctcctcctttttatcgtaatgcccatatcccattcaggagaaagtcccaccggctctaccttcaggacacaggcaggttcagaccatgtcttcccatcttgctgccaatgccctggttcggggtcctgaccaccttcctcccttcaccactgtgtattctctcagcacagcctcaggagcagggctaaaccccaggtaggtcatgagatcgtgtcgttttctaggcagggccatccagtgccccatcatgtcactgaaagaaacctccaacccttacaaggaccccccagtcacagaggtgtcctttctgttccctgtccctgcagctccactgtagcttgagccctggtcctaaccactttctctctacccaaattgttccccaggtattcactgtttcctttgtctctctcaagtccttatttatagaccacttcctaagtacggcaccgctggccacccagaagcctcacactatcccatccctttttcttaattttcttcacagtcatgtgtcatctgccaatattgtatatcatctgccttttatgttgttacaggttttatcctgtcttttccaactggaattcatactttagaagggcagatattttatctctcttattattaatcatccctgatgctgggggcagagcttgctcaatagcaggtgcccaataacgatttgttgaatacattaatttcaagtgggatgtataatgttacttctttcacagtgaaatgtggagtcactgcaatcttcagatgcaaaaattccatgagaaattcttaaaatattctagaaattattttaaaaattttctcttttgccgatttttatatcatgcttcccatgaggtttacgtattaaaggagatgatttgttcccttaagatggatggttagtgagcacgatgaggctagtcacatctttcatagattatctaattcttttgtgaatattatttgtggaagaggcttttataaaacataattcagaatgatcatactaattggaagaagttattctgagtatcatttacttcatgatagttcatcttacctagtttaagaaaagaagtataaatatatacatgcacagaatgtgggcatgttaaaaaaaaaaaaagcaaaggaaccttgtgaaatgcatagtaaattgtgacactgagtgatgtttcacttgtgagacactattgtgagctccttacatgtattcacttatttcattcttcagcaagcaggaatgagctgtgatttttgccccattttacatgtgaggccatggaagcacagagcggtagagaactttgcacgtgttactaactagtaagtggatgtattagtcagtgtgctccagagaaacagaaccaggatttattgtgggaattggctcatgtgtttgggaggccaaaaggtcccaagatctgccttctgcaagctagacatctggaaaagccagtggcataattaagtctgagactgaagacctgggaaccaggggagctgaagatgtatgttctgggtctgatggttcaagaaccaggagctctgaagtcagggtcaagagaagatggatgtcccagctcaagaaaagataaaatttttctttactctgcctttttttttttgatggagtttgactcttgttgccccaggctggagtgcaatggcgtgatctcagctcactgcaacctccgcatcccgggtttaagtgattttccttcctcagccttctgaatagctggaattgtaggcttctgccactatgcctggctaataatttatatttttgataaacatggggttttgccatgctggccaggctggtctggaactcctgacctcaggtgatccacctgcctcagcctcccaaagtgctgggattacaggtgtgagctaccgtgcccagccttttctctgcctttttattcggttccagccctcagcagattgaatgatgccagttcacattggtgaaagcaaatcttcactcagtccactgactcaaattctaatctgtcctagcagcaccctcacagacatgaccggcctcttaccagctatctgggcagcccttagcccagtcacactggcacataaccttcaccatcacagtggaggtgctgcagtgagggtgggcagcctggtctcgagatctgagctggtgacatccataggcctcacaactgcaggtggagaggttccaggagaagagcaagacccggagcacatggctgtttgtttgcagagcatgaacggcagttgcctttcctgcctctaccctccggctctggtgactccatttccttttattctttttcagttcagtgcttccattcataggatagcttgagaggtcttaagatatgaaataaaagaagaaagttggcgggaacgtgtcaatattctcctcttgatgtctgtaaaattagggcatatggagtctattcaaaaggttaaattattgatatcttaagaattgaattcccgttagcaactctcagtagataacgttttgatcagtatctatcagtaggtaccattttaatcatttagtagctactacacactgtaaattgtgttctacaatggcaatcattgcaaacacctatccatgagatggattttatcataatttctattttcaagatgggagaaatgtaaaggattgagagacttaccagagatcacagagctagtgagaagctgagctggcatttgaactcataactttctaacatcagagttgagcacttaagctcccatattctgcagacatcctaattgttgccactttcccattgaaatgattacataaaactttctcttctttttttccaaaatgagtgtctgaagtgagtgtttgaacatgacatggtttgttgaggggatttgaactcaatgaagtgctgctaagaagaccagcggctctcaggagtgcaaacctgtaccatgtctgcaattctgaggcttgttaatgcaggttccagctctcctgctgtgccttattctgtgttacgttgtcaaggttttgtagtggttaagatcccttcatatgaactagcatatgatatttgcaagtaacataaagctcaggttctgcttggtttttcttggatatgacattaaatttgttaatccttgtgcaaattgcatgccatttaaccagtattttgttctggcaatcattgtgaaactttagtgctgtaatcatctctctttattattttaagctctatgtggaggctacatccaagggaagagtggaacagtcctttctcctgggtttccagatttttatccaaactctctaaactgcacgtggaccattgaagtgtctcatgggaaaggtaagaatctatcataggtctcaaacatacagactaataaatgagacagaaaaacgggaacaaaacaaaaacatattacggtgtaaacaagtgagataactacttttctcatgtatagttcaagattttaacttattatttaataagattttggaagaacaatagtctttcaactgtacaataaaaaccattccccgttttgctctctgtttatcagataacctgaatatacgcatgtgaacataagcttgaaatatagctatcgtggtaaggaataaaggcatctattcaataaaatctgaccattgattaaataaagggaaataagcgattgtccaacttccaatttcatgatatatctgggacaatttttgtactttccttgtattttatgtttacccagtatcatcatacataatgaataatttatcttcacataatccagagatggctcatagaatagatatttctatcctcattttataggtaagcatagtgaagatcaggatattttgcattttgtgcaggaaatgtagattataaacactgggattaggattgtagcctgaaacttttttctgtgactaaacgtgtcatctttaagagtctatttggggccaggtgaagtgactcacgcttgtaatcccagcagttcgggaggccaagacaggtgtatcacctgaggtcaggagttccagaccagactagccaatatggtggaaccttgtctctactaaaaatacaaaataattagccaggcatcgtggtgcatgcctgtaatcgcagctactctgggggcagagtcaggggaatggcttgaacccaggaggcggaagttgcagtgagctgagattgcgccactgtactccagcctaggagatagagcgagactctatctcaaaaaataaaataaacaagagtctatttggaatttcgatcacataagtattatgtagacttcgtcttttcacatagatttgaacccgacttaatatgaaatggctacattttattatgtgtactgtgtggcactatgctgccatgaatgacatgaaagaagaacttgccctgaaggaaattaagcataaagaagacacagattatgagtgatcaaagttttataatcataaaaatacacatttttattagaagttatctgttcacagttaattttattaatttcactataggaatccagaaataagcctttgtagttccggttactatgaggtcatatgctttacgggcatctaaaactacatttttaaggaagtttttcctcggttatgcagacctccaaataagatttttctaaaggacacctgtttagagtaaattgaaaatttgtctggtcctttgtccctctgggacaaatactgtccctaagagtctactgacaatttttaaatgaaacccattgtaaacattctcacctgtttttcttaaatatacatatctatgccaatatgtacatctatatctgtatctatatataactacatctataatctccatatttcctcaatattgatgtccacatcatatcttcatatttacatcatatctgtacttatatgcacttaagtatttatttttgttgtttatcccttctgctttttttcatttctaaagccgtcctctttccaccaattttcctcttaaacttcaaagctagattttcatatcaagataacattttaatattttgattaaggcttgatgtgtctaagtccagaaaaaatttttcagcaattgttacctctcctaacctctctctttttctctctctcctctccatctctctccatctctgtctcatctctttatcatctctgtctctctgtggctattactctctgcaatctgtcttcccctcttattttctcttcctctccatctctgtcatctctatgtctctgtctctctctgccccgctccctctctgcccccgccgccccgtgtgtctctctctgtctctctctctctcccccggcttcatttctcaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcaggtatgttggtcttgtttgctgtttctctcctctggcaacaatactgccatttctgttagtgagaatgtgtgtgggtgtgtgtgtgtgtgtaatgtgtgcatccgtgtgtgtttgtacatgcgtgacttgattccaactaatggggtgcaggaggctgagcctccacgaagcagggtgcaagtacagttatgtggcatccagaaaatgccactttgtgttacacaatttgtgaattctcgtctttgaaaaatctgtagatgtcactacattctgcaaagcccttctcactcgattctcttcaccaactctacaagatctctgaggaaagttcctttattgggaggcatcctctgggtctgttgtcacctgattgcattggtttctaccctacggtaggtgccaatatttgcattgacaaccacctctaggatgaaagaagcaggtggacacacacagttgaggatgagcttgtagtttaatatattcatatgcaatgacaaaaaatactccaagttaggtaacatctttatttttaatgataatatatagataatatttgcataaggtttatgttacagcagaaattatttgtatgggttagattgtttaatttgtatagttctatgacagagatgctaattttttctacagataagaaaaaattgccgccacttaaaaactggccaaacatgtgagagataaacttggtcacataaacaaatgatgctcagtgaacaggtcacactgagaacctctgcagtgtcttcatttccagcatgcccccaccctccaccaacagaaagggccctgctgcactacagctgccaaaggatgggaacaatcatattaacttgcatttgtgcatatgatgctttggacgaagagggttttccttccttattcctcatagcccagatcaaatgtaattttcataaggtggtccctgggtaccacagtcacatgtaatttattctacttttgagatctcataaattccttaataacttctgatgccacttatgagattatgtgtcacaatagttgagtatttatcttatctcccaaaccaaaactgaagatcttggtagaaagtttgcttgccccacttttatataaacaacagctctactgctgtatgttactgtaagatgagttactcataagtaagatgatgttccactgtgcggggatcgacacccctaatccttgtattattcaaggtcaactgtagttcaataatacaagggttggggtgtcaacccccacacagtggaaaacctgagggtaactcttgacgccccaaaaacttaactactaatagcctactgttgaccaaaagcctacagtcaattaacacataaataaactagtatctacatatattttgtgctttcatgatatacctaacattttactaatttctaaggtaagtcttgatgacatggttcgtctgcatgtgtttttaagttgtagcaaatctccaaaaaattgtcaatgtatttattgaaaacaattcatgtataaatggattcaagtagttcaaacccacatttttcaagagtcaactgtaataagaacttcacaattgcctactaactagtgcatgttgattaacattatgtaaaatcaaatagtgtcttcaaggaaaatatttcttggggattttaagatgctctgaactactttatactccctctaattctacctagttgccatttatcttaatctgactttgttgatttttcttggtatttcactactcaagtgaagctttcaagactggctcagaccacttgatttcttggaaatttgttgtaatcagcagtaatcatgaaacttgccactttatatatcaaagacttaaatcttcccaacactaattcctaaatccctctctctctgcattctcccctggtgtatctcaattagtattgctatgagaatatcacttcctccagttcttactttcatcaggacccaaaatgaatttaaatagacttctccaaaaaaagaaaatggcagtgacgcaagtctgttacagttcacttctgcaggtgtttctcagaagtctgtgcaaattctattcattttactgcatcagtttcttattctggtgccctcaccacaggtctgacagtaactcttttgacgactactgtcttagtctgtttgtgccacttgccataacagcatacctgagactagataatttataaataacagaaatttgtttctcaattctggaccctgggaagtccaagatcaaggtgctggcatctggggtgagccttcttgctgtgacatcacatggcagaaggtaatatggtcagaaaggggagaatcgcccatatccccatggggtaaaagagaagaagcccttttaatggctttaatccattaatgagggtgggtccctcatgacataaacactcccaaaaaggggatcaaatttccagcacatggattttgggtaacacactcagaccatataaaagtcagaatgtaactacacagctgacactgtcattataaactacttgcacaaacaagcaagccaacaacaataaaatactctttcatgggtctttaaagtggttaacagtctgtaaacattcagaacaattcatttaaacataaccagtagaaaataatacctaaagcctgcagaagaaataaatttcatctagacagttgcacacaagcagaaagtctttttaaaaacaaaagacaacactttggatttcaaagtcgactttaaagtaaacaaattcttcaggtatgttagaggagtaatttcatttggtaggatttttgcctagaaactgtgctgcaaacaattgccagtgacactgataccatggagttttttttttaagtatacaaataactagcaactttattatacaaatgaggcatttacccatccagagactttgtggtttatcataaatggtattcatatgcttttatatctgccttctttcctgttaatcgagtttatttctgcctttctcagaaggccttattaaagcagtgtttcctgattgtgtttcctagtcagtatttctgcagatgttaacggtaatattgtagaaaaagagccccgtattccagttggcttagataaacctgcacaatccccattctacataacattgtctgctactagttgctaactatgtgcactggatactccacacttactttcccactcgctacgacgtgtctacttcttcagtgctaacttctagtgaattagcatcatttctcagtcattctcttcaaaaggttaaaagttggaccactttgtgccattacatatgtgattttctcttcattcaaaagccttggtggcaggcgcctgtggtcgcagctactcaggagactgaggcaggagaatggagtgaacccgggaagcggagcttgcagtgagcggagatcgcgccactgcactccagcctcggcaatacagcgagactcggtctcaaaaaaataataaataaataaataaataaataagcctttctacatttttcaccaggcaaaactcctcctgtccaggtcagagggtgtctctgacatgcagcctttcttcttttccctaggcagaatttgttttcttctatataatacaggagaaaaacgtttccatgacgtttttacaccaaaattattcctttcccataatgacttttctgtatttgtctccttcaatggtaccatgacttttcaaatgaggatactgtttcttcttctgtggttgagtcatgagtacctgggacagaggagagtacgctcattctttaattgcctaggcaggtctctgacaggctgagacttgattgtgaagcagggaatggacaggccagctaatttgggtgggctctcagcagacagaggtacaatgggaggaccaagacaccaagtttaggataaagcagaggggcactgtggccagacccctgaaaccgaggggaaagtggagggacgtgaagttagttatggagggcagataacataagtaacttggatgttaactcaggatgttgcatgaagccattggatggatttgaagagcttgacatgatctgagctttttcaatgtttacttgaaagacaatgcgtgagtctcaacaggaacatgttacacaataatcccagcaagagatgcaagatggaagctgagactacaggaaggatgcaaggttagagctgacttgattggcaggaagtgaaggtgtcatataaaatacagagtggggtcaagattttgcacctgcatgaatgaggatgctctgttttacgtgaaaaccactggaagcaaagcaggtttgggaagaaaatacagacctttttctcctggggatattgagggatgtattcaagagtgattgacaagagtcttcagttcatataacaggatcatattaaagaaaaagaaatactggaaacccatcggcatagaattaatttcaacacatggggcagcagaagttccgaatcagccaaatgagaagttgggtccagtgagttaggaggagagtggcatccagggagctaagaaaggaaagcctttggagaaaaaagagagcattcaactgtattaaaacctacttagtaagaggaagcctaagaattgaccattggtttttgcatccggaggtcacagtggctttggtaagatcatttgagtggaaggctgtgaaggaaagcctgaatagatgagaggaagacagtcttggaagggaggatgggaaaatggaaggtacacccaacactttgaaaaatttgtgctaatgataaccagagtagggatatggtggctgggtgactgtgaagtccagagattggtgttgttagtttgttttgttggtggttttggttgtttatctcattcttaagattgaccgtgtaacgcatatttttatcttgatggaaataagagaattgatgaagggggaaaaaaaggataaactccaagaacaaaatctttgcgttggtgagaagatggaattctgaaggcaatacacttttcttgtgttagacaaagatgaacatgcacaccttgcaaatatactttgtataataatgattaagtgataattaatataagagaatccttagaaagcctaatcaagatggttacaactaacacacaccttctaacctcatggtgttgtttcaggctttctgtccttctaagttgctttcagaggatattgtataaactacaatatatagtaaaaatatacttaaagcaaagaaccataagatcatggtgtttctttatataagataataggtatagcacataataatatcaaaatattctcctgtttggcaagaatgtttttgtttgtttttttttttttttttttttgagatggaatcttgctctgttgcccaggcttgaatgcagtggtgcaatctcagctcactgcaacctccacctccagggttcaagcgattcttctgcctcggcctcccgagtagctgggattacaggcatgcaccaccatgcccagctaatttttttgttattttttattttattttattttatttttagtaaagacagggtttcaccgtgttagtcagtctggtctcaaactcctgacctcatgatccacccgcctctgcctcccaaagtgctgagattacaggtatgagccacagtgcctggagttttcaactatttttaaagaaatgacaggaaatgtatggcttgaattgagtgcacacagtatatccttagatagaagtagaatgataacagcaaggtatgtgataatattatctgaattgtgacatctttattttaatatgttctaaaaagtaaacgtatgataggttgtcaattaatgtttgttgagttcaattaaatgacattgtctatattattttctttctgagtcatactatgcataagtcaaattaataagtatatctcaaggttatcaatgttagtttgaatgttttacagatccagagtagattgcttatctaaacgcaaagataattcagaaagtatccacctcagagctttaccagtaagctaagtgagatgaaggaagtgtttaggtacagagttccataaaagtttttataaaagtgcaggtatgagatctcagtgacaaactcagcagataatgaaaactaaactaaaaaaaaaaaaaagaaggatcagatttgaggaatactaaggggaaaaggatcagttggattttatatgtccagtgaaaataatgaacctaaaattccgagttaggggaaccctaaagatggtgttagaaaaaagtagaagtaattttttttagaaagattagcatagttttctaaacgtttcttccccacggtaaactaagagtgatcttcattgtcccaattctttgcaataatgcacatcttttagttggcctttcaagattctctctgaaactcttcttaccattccaatacctaagcatattttcctagttggctggctgactgtttgatactatctgacaaaactgggcattacagactggggaaacagcaagaaggaggaaaccaaacaaataggcacttacccacactttctcacttcccactgtcaaaaccatggacttgataatggaccaagaggctggtgacagccagagctcaattatacgtacatactacggagatcagaaggagttggctgtaaagaacgtggcaaacacagaagtgagatatcagtgctgacattttgaatacttactcccaaaatgcagcaaaatatcagacatttattttttaatttatatttagcacttccttcttgaatggtttatagtaattttagtacaaaatcttgtctactacttttcaatctcacatggtttacagattgaaaataaacagaggaaaattccactgttcctcactgaggtatattctagaggcaaaattggctctgataagatttccagaaacatagccctgtgcctttgcttttatgttatgcttcatgcgttagttaccaaaaagcacctttgggagggatacagtaaccaatttaagcaattagaaatatcagtaaaattattccacactctcaagctgacagttttgaagtgaattatctcattttaatatgctatttgtctgcttgtcttctagttacataataattgtacacatttatggggtgcatgtgatattttgatacatgagtagaatgtgtgacaaacatatcaagatacttaagaatcccatcacctcaaatatttattatttctttgtgttgggaacatttccgatcttgcctttgagctattttgaaatgtacactgtattattactcactatagtcaccttactctgctatcaagtattagaacatattccttctaactgtatccttgtatccattgaccaacatcactttatccttccctccatacacccccttcccagcctctagtaattctcattcttacctgtcaattcttaaaaaaaaaaaaatactaaatcccatgtcatttgtcataagacagttcatagtacaagaaaaaaaatgcacgtaacagttataagtgtttggggaaaatatatatgtaggtttttttttttttttttagtaatagcactttttattcttgctatttaatctttgtgtatttacccaaatcctcatgcatttactctgtctctgcatgcctcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtgggtaggtggtcacacgctttcatttcattcatccatgggggcagggtctagcccaggcaagaagcctagggtggtcggggtcgggtgggggtttgttgacaaggaaggagagggtgaaagtgtgggctccactctgccaaccaggggagaggggagctgcctaactgctctgggcttgaattagctcatctataaagtaagtccctttcagctctgaaattttatgattgaacaagagtgaaaccaaagcatgtgtcaagcatatttatgaagggaaaaaatatatatatacggagagagagaaaatctggagcaaaagaaaaactggaagatagaagccaagctataataacacaacctctgacaattgcattgattaaaagcagcacgtgtcccttggtataacgatggtgacaattttgtttttgttgtcagtggcagcctttgatgggatgatggttgcacactcctgctaagtgggcacaagaggcatctgaatgctgaattcactttttcagtgtgttctggaggaatccaagagataattccgaagagtaacaggaatttttatttcggtactttgccatgaagtactaggctcacatgcaggaattggcttgctgatccagtggggtgacgtttattagcaatctgggaactgtgccactctaagaagtttagcaaaggagaatcgtaactgccgttgtagcttaaatagggtgtgttgtccacacagccagagctctcgtagttagctatacggacaacgtctagttcctgccacccagccatgttgctcagcatattctgggtcttacaaattgttctttaaagttacagaaaactgactaatgtcattgtgaagaaaaaagggagatgagagattaaccaaggttctccttaataccaagccttctgagtccatggggagtccagaatacgaaccacactaatttcaccagttaacgaactggaggcaggtggggaaggtctgaagataaaatttaacagtccatataaaacacaaacatgttcacttagcataacttgtttagcataacttgttttattttaccatggtgcagaatctctttgattctgcctttggggcagatttttggggttgcttagggatattatgtaactcaaatgataaagctatatttctggattttaacgaaccagagatacacagtcagaatttcgttattaaaaaattaaacaaataaacatgaatcaaatcatctgtgtctgtttccaaaacatgtatctatatattttcacaatctgcttttctcctaaaataatggttcttactgtttgtggttataatatttatttgagaatggaaggcaaattttgactgttatctcaagaaaaaaaatacggtattttgcaggtgatcataggagttcccagaattggttggagtctaaagactcctgactgagatagtttgaaatctggacaaaacccccaactcaatgaaatcaaggtgacatctagatatgtaacagtcagtagtctactgattataatgattaagacccattaaatgttattctatttcatccagagtcattatctttacactgtttttcttgtcattcaggtttttactctgtggtctaaaatatgaaaactcagtaactagagttggaagaataggtactatttattaaacagtgtgtggtagactaggcactgcttcaggctccttccatgtaataacgtgtttagtcccatgacaattctacgaagtaaatgctgtgatggacagttccctgttacatgtggaaatgttaagacaaaaagactctacaaactttgcccaaggacacagagctaggaagactcgaacccagggagcctgcaactcagcctttaaccaccgcactggacaggagggccttggacaggccctttttgtatttagccttttgcattttgcctgcagtttcctgatttttcctccagcccctctggtgcattcgggtgctgtcttcatttctctctaattccccacacctgcttatgtcctagctctggaggattctggccgctgcagagctctcagttcaggctcctcctccccaccctcctagccccacctcactccagaaccccgcagtccccctgatgctttccctggctccccagaccccaccaaccccaggggccgcagctcccagaatgctctctccaaagtgaaaaccccatcgatttgcccagtgtaacagagcctggtcagtgcttcccctactaatcagagcaatcactctccctccacgctgtcctggatcagagtccctcattccctggctctccagagtgcacccagtgctcagccagcagcctcctgcagacagatggagccctctcaggcccacagagcaccagggctctttctataaggttggtgcaaaagtaattgcggtttttgccattacgtttttttgttgttgttgttttgttttgagatggagttttgttcttgtcacccaggctggagtgcagtggcacgatctcggctcaatgcaacctctgcctcccaggttcaagcaattctcctgcctcatcctcccgagttgctgggactacaggcacatgccaccacgcccggctaatttttgtatttttagtaaagacggggtttcaccatgttgaccaggctggtctcggactcctgaccatgtgatgtgcccgccttggcctcccaaagtgctgggattacaggcgtgagccacagtgcccggcctcaagttgtcttcatctctttgtctccctcctcagactgctggctcctttacagtggtctgcctcatccctaagttctgtgtatccaaaagaggaaaattgctttcctcacaaggttctcttttcatctcaaaaatttgattcatccatgcttcatgttcctttctctaaaattatagaaataaaaatgatttgcctgtggcaaaaaagaggcaaatccataccaaaggttgcaggtgacacctaaggatgtcgactgagttaaaagtgtgccgttttaacctccctaataagtgtctgacttaaatggaatttctagtgagcatctgagctgagaactatttctctctctatcaagtcactttgaaatgaaagagatggaaacttttttattatttgtgtttattcattttagggtttttttcaacctgatgatgcatttaggatgatagaaatagtatcatgtattccttgggtattcaacctcaatgctcaaaccctctcttctggcacctgttggcatgtgcattacacgtgtattgtttaggatcttctttttcacttgcaaattagagaaaaagttgcccacattggcttaagtcaaaatgaaagtttattggtaaggtgatgtaaagtccatacctagggacatcttcaggtgaggtttgatcaagggttcaacctcatcaacaagaacctgaggtctcagcatctctcagttttgccagtctgggtaaagcactgggtggcttcctgatctcatatcatcacatacagtgctgtagccccacatcgtgcagttctgtggaaacagctatgtgaagatcgcttatgtacaagtcctgggtttcctctcattggcccacattgagtcccatgcctattcctgagcagtcattgtggccagggcagtcgtgattggcttagcacatttagaattccatctgcacagcttttgaataataacaaaaactgaatattttgtgatggtttgtgacattttggtcaaaagatcaggagcaaagttagagagtatatatgatggagataaatgtttgctataattccataacctaatattgcatctatgacatcatttcagaattatttgaacaaaaaattttctcagggtgttaaagggctgtatgtatacatcagcataagccttaaatccgtatctagtaagagatttttttaaaaaatgaatgaaagtgagatatatatcctcttattgattaactgtattaactctatttgcttgacaaagtagaaagtcattgggcgaaataaaaaacgaaaaaatatcaacacccttatcctcagtttttgaatggattacaagttatttccgacagcatagtgaaacaaaatatcttgcctgtattttaatttaatttatatctagtttaatttatatctagtttaacactaaactctctttctctgtctctctatatatatctatatctatagatagacatatctatagatagatctatagatagacatatctatagatatatgtatatctatatatagggagagggtttagtgtatctatatatgtatctatagatatatatagagagagagagagtttagtgatatatatatatcactaaactgtatataattctatgtagttatttaattttgggttaaaaaattgaaacaacgttctaagctaaaatgttagtttctgttgcttcttaaaagctaatccaataacggcactaaattgtaaaaataaaggtttataggataatgaatgggctaaaaatagtaccattttgtgaaattcttaaatattcttcgtgagtaaatatggaattgcatattttgattaatatagacttctattacgggcaagatttacttatttgttgcgtagaacacaatgaacttggtttaaaggagaaaggtagactttctgtttctgtttcttagttgagctgttttctatttctgtgcttttaaaataaagcttctaaaacatagagatctgcatattaatagttttcccaatttcacagtgccctcaaaagccccacaacaatttctacattttaataaccagagccatacacctttacttccagccattatgttaagaaacatctctgttaaatgtgaggcattgtataggctcgaggttatttaggtggacaagttgcttcagctgtagaatttgaatccaatttaactgtattgaataggcagattgagaggttatatattttcacctactttttaaaataattaaataaatagttatttaatgtccccaataaaatgaccttgccgaatattgaatatgcattaatttatacagacattttggttaatgctatggatttggggcttcctagcctccacgtctgtctgttgttgaggccactctgtctgtggtactttgttacagcaggccaagcagactgagacaggaaatttcacaggtagattcctttgtacagaagaattgactgaaaaatcaattaactcctttcttctgtgttaatttcattttaattagtttcattcaattgcaaaaatctaagtgacaattcaattatagttaacatttcagtagcttttttataaaacagcaagtgatttgtattaagaaactgtgttcattcatcttaaattagtattaaatagactattgaaaaacttttttaaaatgaaacatttaattctgctaatggtgattttcaatgaatgttttaaatcaagctcaaataatttttgaaattttggtcacttaactcttgtgattttctgagcacttgctctttacttaatgtcagtgtcttattaaattacgtcctacgggatactgccccagggtctggagcgctctcgcagtttctttgacacatccattctttcatttgaatatcatgttgtatctgtttttgtgtactaggaggccacctgcacagctttggaaataaggaaaaggaaacattttgtgatatgcgagctatttggtggtatcttggtcagaaaggtaggggtagtgttagagagcagataggaatggagataagaagcttccgcaagaattcttctgatttaatttgaaaacggaattaagtcagaagacatgcctccaaaagtataccaatgtttcttcaaagaacattttgtaaaatagtaacccatcccattcagaaagttgcttccctcagcagcaacactttcctatcctcttggaatcacaaggttattaaagtcataagcaagtagccctcatggattatttcctatctgccaataggaataattaccaatattgtgtattaacaaatgtagtataattattgcaccttctgataacagattgcctggggttcaaatcatagtttccctctcacacctgtgtgatcttgagcatgttaattagtgtcattgtgcctcagttttctcatctgtaacatgggcttagttttgttatatacccccatgtgtttttgtgttttttgttttgttatatacccccatgtgttttcgtgttttttgtttgtttgtttctttgtttgtttgttttttgagacagagtttctttcttgttgcccagagtagagtgcaatggcacgatcttggttcactgcaacctccacctcctgggttcaagcaagtctccggcctcagcctcccaattaggtgggacaaccggcatgcaccaccatgcgaggttaatgtttgtatttttaatagagatagggtttcaccatgttggccaggctggtcttgaactcctgacttcaggtgatctgcctgcctcgcgctcccaaactgctaggattacagatgtgagccaccgcgcccagccaatgatgtaatagtaataagaacatgcactgtgtaagtgacaaatagaccaaaaacaaaattagataaattcctgtaccccatcaggcatggtattattacaacttatttttcctgtgattatttatttgaactttcaaagatacttctcttctattgaaattctagaatttgtgtcacaagtcaatcttcacaacatctataccttctgtgtttttgtttaaagtctttaaaattcaactgttttagggcattccctgcaacctggttcaggctgtgtttgcaatcccatctcccatagttccttcatgtgatgctccacttcagtcatgttgataaaatcataaaaacatcctatttgtcttgcacctgagagtgtgcccaggtcctggcattccttccccacccatgtttctcagtaggcctttggagatgccaacacggctgcggtgtcaagtggactcatgaagcactaggccctcaggatacaatggctaatcatgttcagcatggaaaatatcatattttcttattgacttccacataaaatccgaaaaaaaaggtgacaaagcaaaaacaaaactgtcctatgttcagtaggatggtattaactcaaacacaaataacggctgaaaacagagaaaagatgtaaaagtcataatttaaatttttaaaaatgtgattctatgttaatcgtctttaaaatctttgaaaaatataggtactaaaatataaattaaatagtgagtacacattgtatgtatattatacatgtgtatttaatatatattatacatttaatatatttatatttaatacatattaaatatatatttgatttttgtttctatatacaattattcgtatatcatttaatgtatatgtattaaaataatttttctagttaacaagccaagtttgtatactttcctttcttttcttttctttttttttttttttgaaacagagtctcacactgtgtcgcccaggctgaaatgtagttgggtggtctcggctcactgtaacttctgcttcctgggttcaagcagcctccgaagtagctgggattacaggcatgtgccaccacgcctagctaatttttgtatttttagtagagacgggatttcaccatgttggccaggctggtcttcaactcctgacctcaggtgatccgcctgcctcggcctccgaaagtgctgggattacaggcatgggtcaccacgcctggccaagtttgtatactttcatagcaatttaatacttttggggaaaatgccatgtgaaagactatcttttgaatcctgtgccacactaccctagagtaatgaaatcctacctttgtacatttaagtgttttggtcatgtatattcacattcagttatagctacatattgaataaatgagctattattacatattcactgagaaatcttaattgcatctcaggttatgagagatacttattcagatactaatagaagactttagtttcaagctgtgaatataaagtgagatttgggaagtgctagaaggatggtgagttgcttttgccttgattttttctaaaaggcaaagcagcagcattgtctgtctatacagggtcatcagttacaacgggatggttaattttgcacagttattattcttgcatagtgaggacttgaacttagttactaccatttattatatatctgctttttttaaaaaaaatcccagattccaaaggctaataaaaacatgtaaaattatttcttttggtttagattttttttcttcacatggatacaaatgctcaattattctttcttgtcccaccttttttatgtattatgagaaatgattatatagctaatgtcctaaatgctaatgtaataacaaatatcagctgcaattaatcggtgacctatttagaataaaagtccttaagaagacacttttttcttgaacatttaaacttgtgttactccagttttattattaattatgaacagtagtgtgaattattaattttaaagtacatgtaagtgttatttaggatattttttaaaagtgctattccctttatgagtacttcacagtttatatcacatcagtaattaatctgtactagctgtgtgaccttgggaaagacatttggtttgtaaactattctatgcttcagtttcctcatctgtaaatggggtttattgacatgtcacgaaggttattataggtattataacacacacatacacaagttattataggttattataggtattataacacacacatacacaagttattataggttattataggtattataacacacacatacacaagttattataggttattataggtattataacacacacatacacaagttataggttattataggtattataacacacacatacacaagttattataggttattataggtattgtaacacacacatacacaagttattataggttattataggtattataacacacacatacacaagttattataggttattataggtattataacacacacatacacaagttattataggtattataacacatacacaagtaattataggtattataggtattataacacacatacacatataatatatattatatataatataatatataaatatatataaatatatattataaatatatatatagatataaatatatttatataattatatatatttatatctagatatattatatatattttatatgtatatttatatctatttatagatatatttatatttagacttatatctattttatagctataactatataaagtatttatatattatagatatatacacctactcgtgagtatatatacatataaatttctcttttaaaatgatttttacagaattataattatacaaatacataattatagttatataattactgtaatttcttaaaatgattataaattcccaatggcatctttgagtcaccaattgcctgcacttccgcctcaacacttgcaccccgagagccacatccaaagcctgcttttctgtctttatttaaggaggatgagggagaagtgaacccaggatgtcaagcgttctcctctctgactttctcctcacacccttccacatggaggcattctgagattcaacgtgcacaaatcactggggggcaatcatggatctctagcaacttcctgctggcaagtggattaggatatcatggccagtgatgtagctgattgtgttcgttgtcaaagagggaaggagggtgtgaaagaatcagtatcgtggcagtgggcatgcagaagtcatctgcaaaattctgcagtaccttgagcaacccagtggaaaaggaatactgtgcatccttctctcctgctctcagtacatacctggcatctaactgatgcttggtttccaacctgacaattattcttcaaaagaataggcattctgtgggatgtttacatcggtgtgctgggcacatagtatagtctgtaaaattgttggcgcagactcctgtggagctctcttggcacagacaaacctctgtgtgtgtgtgcacccgtatatgtagccactttatttttctgtgatcgtattggacttagagttttggagctgaaagcattcttgacctaaactgttcactttcactgtgagacaggtgctgaaaggttaagtgactttctccaggttgacagaaagtagagagttgtatgtattttcacttttaccttgataagaggaattttgtttgatacaaatttagatctagaagtcaatttttctcttccttcattgggaaagagggagaagcagataattactgccattgaatgttcttccattataagacataatgctgaggcattcagggatgtgacatcctgaagataactcagtggtttggtctgtcgttagattcccctttgaatgcgtcccagttgatgccataagatgtcaatgaaggaaaatgcagacaaacaatggtagaatgggagcgtgggaactggtggggacatttcatgaggcaggaatgaggtgggtgggagaggtgctgtgacaacctgacgacacagccagtgagccatggtgctggagcacctctgttttattctagaactctctgtatgatagcatgctgcttccacatagtcagaggtcattctgttaataagacaattttcaaaatgagctaggtggggtatcttttttggtccagttggtcaaacaataaaaaaaaatcactgatctattttgaaataatatattactaacacacatacgttgatagaagaggaggctatcatgattttaaagtttttaatctgttaaaaacagtaattccacttttgaatcctctttctctcatgtcctatttattgtagccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtaaaaagaatcttctccaacatgatgactccaagttttcttctcaaaaaatacattgtctatctatttttctacatatagatatatgcacatattaacatatatttttatatatgatttatttgtatttatttacacaatgagtttgagaaggtgtaatgtcacttcgcttagagcagtgtatgtggactttgaaataactttgtagataaacctcgatctaacatttatcagtccagcaccttatgaaagttatttaacacttttgatcttcagcttccttatgtgtaacaaaatgcaattgtacctacctttctggactgtcttgaggatttaatacaataatataagtggatgttcctagcattgtgtctagcacatagttgtaattattaaaagttgcaggatccccaaaccaaccctttctgtagttaatcttgatttttaaatgtggtcatactgtggaaagctggaaaggttctgaagtgataatggaggtaaatccagccacagtggtcagatcacagacagggctgatgaggagaagccaagccaggacaagacagaatctcaatattgatggcaggggtacccaggtcctgcgttgattgacaaaatcccagctccaactagaaatgcccttaacttctaagagtcctgatataattttcacctctcctgtaagtatttcaataaattgggaaccttccatggcctaggggttggagaatgggcaacctagcctcaaggcactgaaaaggaaaagcttcaagaaacaagagctaatgctataatactatcttgtccaacccgcggcccacaggccacatgcggcccagcacagctttgactgtggcccaacacaaattcgtaaacatatttaaaacattatgagatgttctgtgatttttttaagcttatcagttatctttagtgttagtgcattttatgcgtgccgcaagacaattctttcaacatggcacagggaagccaaaatattggactcccctgctataaatcatccgtccagtcacctgcttatttcagcgaggtgagcaatttagttggacagaagcctggtttctggcaagaaaggaacacgtggctctttttattccctttttaaaattctagggtttttcaattaatttacatctacgtagatgcacataatgatgcattttagattcagtattgtcaactcactttgaactatgagacttctaagagaatatgcagaaagccaactaaaagggaaaacactgtgtgtcctccctttacagaatggctggaatggagcccccgccgggctccacttgacctcattagaagttatgtgcaaaggtcaggagaagcttacagattaaagggccttacttcctcctaaggccgcgtttgcctgtatttcaatgtcataatttagtagagtggttttattctagttgttctttcattttaatagtcttttgaaatctcacactggcagtatgagggactgtcatgaagaagtggtttttaggcaggaaactagcacattcttactaatctaaaaagaaatagttacatcgcaactgaattttttaataacctcaaatttagaagtcagtaagcctttaaggcaaagttttaaataactcttaactatactttagtgcaggtgaatgattagagatactgcataaaatacacaaggataaatattattgcaatggaaggaaggaaattatgttcatttgtgattgcatgctgtttaaagttgattataacaaaaagttgtttttaaaaaaacgtgcttctcacatttaattacagagaagctgtcagtcatataaaatacctacacattttgcaggcatatattttgttaaatatgctaaaaaatatctctgttaaaaatgtttatagtaaaattatcttaattttcaagcctaatgctgttcacattgatccttcgcacatactgtgatgtaataataaagactaaaattttatatacacgcaccccctgcacacgtaaataaacatgatgttttcttgcttcatgtggaaaaatcatgtaagagatatcgagctctcagaagcatgtcatgaaaggaatatagaatggaaaacgcaattaattttggaaataaatctgcagggtatagtttctgtaaaactgggaaagatttccccagaactttcaatgttgtcatgctagcattctgtgtgatgtcttctaatctgtgatcatcagctaacccagcaacatcccttgagtatatggcattaaatgctgaactctgaggagggtttgtagtgcagatacttacaggcttgtattaaacatatgaatcccaaagactttctctaataactgaaaagaaccctttgaatctagctacttataggtgaaaaaatataactaggaaatgttgtacagaacaggtgtagcctgttcctcatccaattggaatcagaaatcaagtcttctgacttccactcctatctgggtttttatttgtgatcagtgcgaaacctgaacccagattttaactttagagaactgacaggggagtgttccatgttcatcaacgacatacactttctctggggtttcggtggttggacccagtgctgattgctgatgacatggataaagaacgcagaattgttgttctgaagaatcttacgattcagcttttgagctgttcatttttagtggttgtaaccatgaagccactgggagcaaggtgcaatctctcagggatccacggtgcgcttggtcaagtcctcatgaggacacggggaagccaagattcaggagagcggatgaacctacagtgtgtcaggacccagcaggggcttcactgagtgtctagttctttcgtatttccccatctttatggatttctgtcaattacagacaattccatggtatacggggtagcccaaggccttcctagggagacctgcaccttttctctttgacccagattcctctggaattaaaaccatttagtctctggatgtcagaccccggctcgtctaataaaaacatggaataaaccaaataatggtttttacacaatgacctgggtcaatagtcttttagtaaggagattagagagtatctgattctaccccactagcatgtgcatatttaattgtaatgaaataactacccacaaaattatcttttctaaatgtattttctccttttctgagtatctatatctgtgtacatccctgggtttatatattgattgaaagacaatgaaagaaaaattaatctgtataaagaggaaagaagtggggaaaatagacaaacacattggaagagcctactaagactctgtttaattttatttagttagggtaccatttttctattaagacaaactgaacattttccaatatcgtgtaataaatgtttatttttacagccccctgctagtgagggaggcaggtggattagccgtgcccacctagtgctctgttgttattgggagcgaggactgctgcattgacttttttattttactttattttattttatcttaagctctgggatacgtgtgcaggaagtgcaggcttgttacccaggtatacatgtgccatggtgatttgctgcacctttcaacccatcatctaggttttaagccccgcatgcattaggtatttgtcctactagaaagtcagtgctgtttctgttacctgagcctcatggcattggcagaaagtgcatgggtcctaaacacttttacccgatcctcattcagattatgatggtgacacagacccactgctccccaccatgtgacctgtctccccactagttgggaacccatgactgaaccttccctctcccggctggtcaaaaccaagccttgtcttccttatcttccgtatacttattacatctactctcgttttacaactgcttgggaagataatgccacatacagagcattttaagcaacatcacacttctgtattactattgcatgatgagatacttctgttatttcaaattcaagatgaaagccaccggaggcttgcagactacagaatgtgacaagattccggcacatcttgttgtcctttagtgcattcagacagaagggaatagaaaggaagggtatgttctttgacttagttgagagttcagaggagatattcaagactaaaatattataaatcctttttacttttataactgaactatgagaaaaggaataaaaaggtagataatgaaacctggaaatgtaaagaaatatttatttaattttaaatgaacacagaaagagctcttaaagtaatgaatataaaatgatctgaacaagaatggaatcttttgcctccagtgttaatggtaaagataaaatttaaagaacaaatatgatttagctctaagtccttcatttatctttctgtaaactatatgcctttttaagtattgtttaaaactgcatctttgaagatttggattgtttattaccattgctaacataagaatccagtgaaggcatagagggactcatgctgtgaattttcatcaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagtaagtaacatacgacttaatcacgttcttttttcattttgtcaggacatatctgatacttggcttatattaagttttaaatattgatttttttctggctgcctactgtgtttttgattgcagtttaattctgtactctgttgactggttgtatattcggacacattactagtagcttgaaatttatctatttggaaatattaattcaaataacaaaatagttggacctgaaaaggaaacgtcttacaacattttagatctgatgggcttaaatatattgattggggtatagtatacattgatacaaattcatgtgcttatatatgaaggctttagaagagatgtttgatacaaccggaggtaatagactttgaatgacacacacacacacacatacacacatatatttatacatttaatcatatatatgtataagcacacacacacacaacaactacataatatgtagtaaactattttcttttcaccattaatttttgagacgagagaactaagaggaatactttgaatacttgccagagataacagttttaagagttggtggagccaggattgaagctgtagctcccagttatcggtgcttcccatcatctgtatgaacaaatcaatgtggaatatgtttttaaagatgtaaatgaagaagccaaaagaacagggaaataaaagagatgctgtgtttcaaaagtaggaatttgcaaagtgataactgccactttcagcatttttagttctgaagtaaaagaaaaagctatttggtgtggataagtaattaaaattaactaattaattaaaatgtttaaagtatataaaattgtcaaatccttcactcatctgataaatgtaaaaactatatcatactgaacaccatgacattagaaatttaaaagtttgggtttttgagcataaaagtatgttagtgatggatacctttatttgatggataggcaaaaaaggtcctgcaaaagataataatcatcccacagacccagagctaatccaggagcctaagacgaagattaatcacctcaaatccctcttaggaggaaaaaatcacaggtgaagaattgtaagactttggccaaaaaatagaataagtgtggctgaaatcatgaggaaaccagtttttcacctttgtgataataccattgaaaagactgagtaaatagaaagcctatgaattaatatttgtgcacaataaactgataacaattgatgttacaagatcaacctataattataaaatttttactagaattttaccttccaggatttccctctcagaaatgtctcaaagagctcttgtaaaaccattttgcttgcagatggaatgaatgctattgtgattgttttttccacttctcgtccctgtcgagatgttcaatgtattttgttttcttacttggatgtcttcatccccgcttccttgcccctacactagtcttagaggaacacagatacttgagaagaaaaactgtttgaaaagcctgtgggtaaattaaattttgtctaattacggggaagttccatgcacacctacggcgttcttccagttctcttgccactgaacacattttcgttgctttttcttacaaatcctgcccctgctatggctccctgggcaaagagcagaaaacgttggcctgggatcctccctctctcctgggacctcactctcaacactgctgcaatttgcgatgttactaagctcactttttcccttcctgtggctgcttcacaaaaaacacattgtgctcagctcgtgtgttatttctcattacgtttccaaccctagtaactgtttcccatgttcctccgactatttccagttggaatgatttctcatttgtaaacacttggtctcattttctcatggtgatgcaaaaagtatccagaagaagatttatgcatactggaatttcaggggcttggaatcaatgtagggatactgagctgtttccataattctgaagcctcttctgttgtccaggtagcagttaggaaggtccatgtgctccagagccgtgtgaccgtatggaaactataggtggtcggcttgttccatgttgatgtccaccctccctcacccagaaggcttgcgtcagtgggcgaggctcagccctgcctggaccccacatggatactgtgactctattgctccccggcatccagcatcactttaggaagttttgaggtcacttccacttcactgagtaactttgtaaaagcttgaatctattcatctgtttgtgggcactttccaattctacagacatttttgattacatagtagcacaaatgttctataaataggagaaagaaatattggagaggattggcacttagctcttattataatcaatttgacaggagtaattttcttgttctccctgtttcacctttctgttccacctgcaaaacccggagactcctcaggtctcctttgcaagattatcttagagctggaacatactgtctggtgggaagatatatttgtaatagaaaattggtggtgctgatggccatataatcaaaatagtattaacctcacattaaattgttagttgtaaatataagtaaataagctgaagaaatccccagctccccaaggtcatcaaatacctgaatcaaatatttattccaaaaagatgtctcagaaatgatgaccggttagataaaatattttacgcaagttatttatgcttaagactgtgtaaagacactttcagctattttcaaaagacttttgtaattgcctcttgatagttaattgcactacttaaggaaacattagtatttaaatgtttcagatccataattaatgcatatacatgagtagattagaaaatgtcaacagagagtaaaatatatagcttaataaaaaaaaaccctaacatttttagaaatgggtacaaacaatatttctttatcccttcatatttataaaagcatacacttagggacctttcaactttacaatcctggtaattccaggtcttgggaaatagctccttctactcttctttatgaattaaaaaccgagtcttcagatattttagtaatttgctgcacacagggagtggtgtaattgcaacccaaatccaggccttctaactgaataccagaattgctgatgaacttattttcaacgattttcggtgatcctcatttggcaggcatcaagtatattgaccgatattgatacatgcagaggaattgcctgggaagaaaaaccagagtatctttgggccaaatcggaataaatacgttgctgaataggcatttattaagcaagtactgttttctgaatagtaagtcagaccaaaataaaactttaaaagtgtaccttcgttagaaaacactgctttttattacagacttgtctatgttcataccagataatatgcttctggtgtataatgatgtccaatggagccataacccatagctctgtgaaatcggggacaatgagtgtccacttgtttgtacttcttcgcaccttacacagatgtgtgatctgtgacataagaagcttagaatggatgattgtcattcaaattgtattccctggtgacactgagggtccacagagctgtatcaggcaagaagtaagagtttcacctgaagtaacagaagcattggatatcagagtagccctctgagagtaatttattgatattgacatagggtttccggtacatggaccagcttcgtcaattatttcaaattacggaactggcattctgatgttaaagtcccattggccctctgatgagataaatctattttgggtacaccgatggaaccagaattctgagcctaccaaatcacccagggaatgcttttgaaagacagctggctagctttcctaaggcaacccccctacccttggctcttaaaagtctcacttttttgatagagaagagaacccatagtcaggaacatctttaaagtgttctgcaaacagaggcttgaagtgaagggcctgtgaaaatggatgaggaattacagatgggtataaacgacattccaaagaaacactgaaaggctggatcaagaaaatgtggcacatatacaccatggaatactatgcagccataaaaaatgatgagttcatgtcctttgtagggacatggatgaaattggaaatcatcattctcagtaaactatcgcaagaacaaacaaccaaacaccgcatattctcactcataggtgggaattgaacaatgagatcacatggacacaggaaggggaatatcacactcaggggactgttgtggggtggggggaggggggagggagagcatcgggagatatacgtaatgctagatgacgagttagtgggtgcagcgcaccagcatggcacatgtatacatatgtaactaacctgcacaatgtgcacatgtaccctaaaacttaaagttaattaaaaatataaaaataaaaatttaaaaaaaaaaaaaagaaaggctggagatgaacagctggatctgcatgatagagctgccacaattccatatggcaactttgtaccaattattttaaaaagaaaaaaataaagccctttctctggaaagttacagtcctcaggatgcaccctgcagaagtgcactggccagccctgaaaatgaatcagctgcatagctggtatcacgggagaggccctgactctgagcccaggcacttggcaacaacagtgtttaatttaaagacagggaaatagggacattcacaattctttctcttcatcctgccccacaaccagatttctcatccctgctgaattttcatttttgggggatcctgaattggtcccctcatcactatcctgaattctctgtctatccctttcttgtacttagctgtgttttgatttacacaatttccattattttatttatgtacttggtcagggtctactgccctcattcacttgctagtttccgttctgtggacactgactcaacttgtcaagaaacgcccagcacccacgcatgactaagccactccctgggcatagaggcgtggatgccagggtgacctggacatggagatgagacaggcatacacgtgtggttcaacaactggattcagatatcaaatacgttgtgtcttgtggctggttttagcacctcagagggatgacagactcctcaagggggtccttttgtatttgcatttatttttggacacaattccaatcccacaacgcctgcttggcattaagtttcatgaatgatatcgcttgggaaataaaagcatctgccaaagtaggaagctagagaagtgtctactgttcagacgtggtgaagaggctcattagggaaaacctagccgagcttcccttccacaaagcaccagtgattcctggccagggtatattggcagaagtttgaacagaggtagaagaaacatcataaacacttacggtttgggtttgtagcagagccactcaaaggaatacttttgtttaatgactcataaaataatcagatccctataggctgactttctctctacccattaggccgattccaggtgaatgtgtgatcagtgcccaaactcctagggagcacttgatctcagcagacgcaagactggtctttgaatcattttgagatggttgagcttaaggccatggacctctctgtccaggcgctggttttgtggatatgcattccctgtacatcagcattagacatagcattgatgaaagagtggccatcgcttaccgagaacatcctctgtcattctttacacctatctcattgtttaggcaagactgccaaccgcaaagagatctttgaagccatcaaaataaacgcaagcttaaattttggttgtagaataaaccttgtggctgagagtcaggcacgggtgtaattatgcagaacaatgactttccctggcttgcttctaagggatgcttcataaatatttgctgaatagatacaaaaaggtttaattaaaaagtgatgaataataaaagcaatttatttcatccaaattggtatgtttatcaaaatattttctgcttttgaaaggttctagactttgagataagtaaggagacggaagatggggatagggcgagtcgttgcgttggtttgtggcagagtcatgtactgaacccttttcagtcttcttcttgtcatgcccagggttccaggggattagtcagctgtgcttttgaggcagggggacagcaaggcctggccaaccccagctccagcctccccagaaagttacagttcacaggacacaccctcaggcacagctcctgtctaatttatatagcaactggcataaggtcagtctcctagaactaactgactttttttaggggagcattattacaagacctgtgttttggagaaggcttgttggactaggatctgaccatctcagacatgctacagattaaggtcaatgccaggtgctatatgaattagacaggagctgtgcctgtcctggaagcccacacacagcccagggccagcgatgcatgcagctgggggcgggactctgaatctgttctgaaaacaggaagttaggtgtgcagggctctcgcccacatcgggaacagtctctgggtcctctgtctggatgggggcacagggctctgtgatgaagtacatgctctcagtgtgccccttgctctgtggtaaagtgagacaaaatcagagcggggtaaagcatctttcctctagttccttactctgttcaatcccaaccaccacactttttcccagtgttgattttatctgtgaagcagggacaataatagtttacttttctaacttatgtagaaaacacatatgaaatggcttttgaaaacatccaagtgctatatgaatttaagtatgtttttcttcagactctgtataacaggggtcatgaaaaaggctatagaaggtgacacatgtctcttggcataggaatgcctacaatttgtgatgggaagtggagacagttctcagggttcaggggccttggaaacactcataataccccaagttgcaaagggactgattagcatgtattgtaactcacacacgaaggccttgctatgatctaacttaatactgatgaaaaccccacagttactatttttctactgccttaggtatgagggaacagaggtttggagaaacctgcccatggttccatggttcaggagggatagggatttttttctaacttcagttactcaaagcactttgtacgttaacctcaacacagtcctatgggagaaatgttttctaggcttaaggattactcatcgtcctctgcatgtaaattagcccaaaataaaaatctacaagcgctgggtaggaaggccagacttttgagaacagagaagccttggatcaggtttctaccttctgctctttgaacttccatccatgaattcacctctctgagcccagtctccaccctggcaaaatgcaaataatagtaaagcactgtgcagatttgttgtgagaattagtgacattgtatagaacatccagctctgtgtctgctctactcttaggtgacattccatacacagaagccattgttaccattaacctttatttattattattattttcttgagtcggagtctcactctgtcacccaggctggagtgcaatggcacgagctcgactcattgcacttccacctctcaggttcaagcgattctcctgactcagcctccctagtagctgggattacaggtacccaacaccacacccggctaattttgtatttttagtagagacggagtttctctatgttggtcaggctggtctcgatctcccgacctcagatgatccacccgccttggcctcccaaagtgatgggattacaggcgtgagccaccatgcctggccaaacctttcttcttatatgaaatgtgagaccatttgtgtcgttgggacacacaccactggctgtgtgtgatggaggggaaattgatcctgtcactgtgctcttcatggcacggtcatcacagtgactgagaggttggaactgtgaattcgtaacacagagcagagggtatgggcaaaaggaaccattagaggctggttcaccaatacccctaacaagtgacatgagagggagggagagagaaacatagtggtgtaggatgtccaaccaccattgactgcaggcacctccagggtcctgggctcctctcggtttcatgagtcatagctatacttctcactctgccatgagctgtatcagaaatgtttaagagacagtatcatctcctagaattaactcacttttttcaggggagcattattacaagagttgtgttttggagaaggctcgttggactaggagctgacgctcttagccgtgctacagatgcaatgggatcacccagtggtgacacattgcagctccccagcaggctgtgctgccacctgcagtgtggatctgcagactgcctggtcatactcagtttaaagaacattagagagagacctaggaagtcccactctacttactctgcaaattcaatgtgaaataaaaaagaatggcatccattctgtaaaatggcccatccatttgcagccgtttgcactgcagctccatatttatgtttttgccacaataagtaaaaggtgaaggtgggtgatctgatattgacgactaattctgaagacattacaacgtagcctgtggatgcgaaaattaaagcatggagctgtgggtttatgtagctgtcatgctggttttattaacacattgatacaataaaaatgacatcaacattaaatatactattataaatgacagagtggctttgaaaataaaaatgacatcaacattaaacatactactataaatgagagagtggctttggacaggaatacactctcaggaccgatacagaagcactaagcattgtcattttggtgcttgaaaacaaggagaaaatattgcaagcatgaagtgtacacagctgctgaatgcaatcaattactggaaacaaacctgaaggtgaagagcagggtatgtcagaatccatcatttggagtccctgaaattatgcgttgatcaagagagataatgctttctttataggattgactgataccttgaaaaggttgatgtcattttcttctggcatcctctcccacctatctctacccaaacacatcagtagacactctgtgtgcgtctcatatagattctttcaatgccttcacctccctggctatgagtaagatataaaagggcatcacgatgggtccatgtcatcattgattacttctttttaagaactagattttggaaatcctatacaagctgaggggcagtcctcaaatgcacattttctacaatctaattttgtcaataataaagacactcacagatttcccagacattcttggttgtgatgtgtaagcattgctgttttaaagtaaaagagattatagtattcaaagaatagcattcactgccttcttgctttttacggtgtattatattttaggaaattgagtcaaagcatcttttcatccagtgagtagttttaaaaattattcacaaccatgctaagaaccaggggaaagtatagaatagggttataaaaataaggaaatattcagcctgcacgtaaatccacactcacagatttttacttatttcaataaagattaagattatggcaaacatattatgctgctctaatatctactcctggcattgcagtatctgtgtagtttgtaaattgcagtatctatatatcatttgtaaataaaagcttacggcaaaattttgtttttacatagctgttaacctagctgagaaaaacgttgggaaaatatccaataagcagtgtttgtttttcccacagttaacttgtagataattttataaagtgttttaaagtgttttcaaataataggcagtgttgtgtaccttagttttctattgctctgtaacaaaataccacacgtgtaggggcctgaaacagcaccgtttcttatctcacagcatccgtgggtcaggagcccagacacggcttggctgggtcttctctcagggtctcacaaggacgtgaccaggtgttggctgggctgtggtctcatctgagtgtcaggggcctcttcaggctgtcagcagaactcaggtcgtcacagtggtcagactgagactcccagctccttggtgccactggcatttccctgccacgtggctgtggtcttctctgggcagggcgtgtccttgctggcttctccaaagccatggggagccctcacctcatggaggccagaccctctttcaagggctttccctggattgagtcaggctccgtatcttgacaaactcagcatcgacagaacagacacttccgtggcatctggtgctctcacacttgccatgttcagttgtcagctcaagtcacagactgtgcccacactcaaggaaggagaagaatcattcatacatccagggttggagcagcaggaggtgagggcatcagggtccctgcaacatctgcccgtcagagtttcctatttaggaatgttttccttccatctcagataatttcatttaaaataaagtgtgtgtgtgtgcgcacgcacacatgcacgcactcccacacacacttgaagacataaagtatatatttaataaagggaatgtacaattcattgcttacatgtacttttaaagtttcaggaaatatttcagcttacagtagttaatctgttgtctgcaaataaaacaggtttcagcggtgacattctgaatggtcacaggcatagttttattatgtgcctcgatcttccctaagcatcagcctcactgcagctccggttggccttccaggcccctcctctcctcttcccagctaattcaggccccacctggagagactcagagatgtctggaggtgggtgaggagcgggcaagccctcagcaaccccaccttcccttctctgctaggaaaagcttacaagagggtcttattcacatgcaaagcaagagggcaggatacaattgtcatcaatgtttaatcttagagatgacgttttaaggaaaagtcattgttttcatgccatcaagcagtagttttggataatatccgtgcatctaatagatatctcaacaaacatttacatttatgtatcatacctgtcatcatctatcatctatccctacgtatctatcatgtgtctgtcaattaattgatcatctattgattgataatctatgatctattatcattctgtctatatccatctattacatatgtatctactgattgacgaggcaattatctatcattatttatctatgatctgtttttatctatctagctatctattatcagtcacctgtcaacaatgatcttctgaatttctctctggaggacaggacactctactcttacataggccagaaaagttgtacattgaaatgaatcaagtttacacataaagaaataggagtaactgctattcaatatatcattcacacggtaactttaaagatctggcatgaagccctgaaggtcagataccaagttcattccaggtacatacgcaagagaaaccgccagctgtgtctttgggggccatggtaaaagagaaatattggataatatatcaatgagcactgaccacgtgccaggcaattcacattcattgtctcattttatctccaaagtagccctttgaagatgatccttttgttattttcagtttaaagacaggaaaccgagggttccataagttaaggtcctatcattagtgagtggcagcaccaggattcaaaccctgttagtataatccaaagctcaagagcttcccactgatacatcataagcattctgtgttttcaccgcatcagataaaaatggccaccaactcatggccactgttagcaaacatctgaaattatgtgggattttgatcagtgcctctggttacatgattctttaccacagatatcaacgttagttgctccctcagtctgaaatcagaatctaaatagggaagttgcttttctttttttttttttttgagacggagtctcgttctgtcggccaggctggagtgcagtggcacgatctcggctcactgcaagctccacctcccgggttcacaccattctcctgcctcagcctcctgaatagctgggactacaggcacccgccaccacgccaggctaattttttgtatttttagtagagatggggtttcactgtggtctcgatatcctgacctggtgatccgcccgcctcggcctcccaaagtcctgggattacaggcgtgagccaccgcgcccggcactgttgcttttcttttatatttgaaatattttatttaagatgtcatctctcatacgtggtaagaagtaatattttagcattttcatgaggtaaataaaaaataaaaacagttttgctatagtatcctacctgctgataattcattcctatatccatgggagagcaacaaaattcaaaataaagtatttgctttttaatcttagtttattattgtaacttttgttttaggtttggggcacaggtgcaggtttgttatttgggtaaactcatgtcacgggggtttgttgtacagattatttggtcacccaggcactaagcctagtacccattagttatgtttgctgatcctctccctcttctcatcctccaccctccaataggccccagggtctgtcatccccttctttgtgttcatgagttcacaccatttagctcctgcttagaagtgagatcacgcggtatttggtttcctgtttctgccttagtttgctaacgataataccctccagctccatccatgttctcacaaaagacatgatctcattcctttttatggctgtgtagtattccatggtgtatatgtaccatactttctttatccagtctctcgctgatgggcacttagattgagtctttgtctttgctattgtgaatactgctgcatcgaacatatgcatgagtatgtctttatggtagaacagtttatgttcctctgagtataggcaagttgtttttaaccatatgttccttcattgtttctaagaaaatgaaatgaagaatgctatagtaattgaagaagtttatcaatgtaaggagaaatctcttgaatgacatttctgtctgcagggctctctacccactaccctgctttgacctgggaggagctgcacccagggatggggccacaccatgactgccatgggcttgagcttcttatacagtccattcctccacacaaaacatcaaacatttcttctcatgactgtgtgcctataactatcaatagatgattgtatattaatacagtttctttaacccagaaatttacttttttcttctgatttaaggaaatcaaagcatttccatgagcctctaaagagactgtgggccataggcactgtgccctgtgcccctagcaagtaagttagcccctagcagacaaggagagaaggcagaaaaggctcactcacaatgcatcaccctgcacagactgatggcatggcctctgctcacactcttcagttagcactggtcctgcaggcccatgcggccccggggctgggcaactctttctggtaatggggctttacttttgatggcaggcagacctttgtagtagcctgagctccaacctgtgaaggggacgcactcatggtacatgagaagggtaaatacggctgtctgtgattgcataggccttgggaagggaactgctgcacattctcatggggaaaagatgttaactagataacagtagtctgtgtgtggctgccgcagtttccccgttcatcatatatgctcccctgtaatgtggaacacatctcgaactctccatctgcttgaagggtcttttctgtcccctgcttatcattcctttctcctgcagaactgggctctgtcacgctgcaaatgggtcatgatgaagcctgctcttaggggtccggctgtccagagtcccctttgcttgctggaaatgtgtcttatagggttcacttttgctgtcaatgaccactttcctagctcagcctcctctgttattgataatatcctaaaacaaggtcatttttcaatgccctcttgagtgctatggcatcgcctctctccttcaattacatatcttccacctccattctatgccaacatctggcatcttctctctccctcaactacatatcttccacctccattccatgccaacagcagcctccatatttaggtaaattttttcagccctaggttcttcctgatgctttcttcacttccctttggtacatgataatggaattctgggatgtaatagacttgagcccaagcacgttataataaaatacttgctgtcttattttgaaggaatgatataatgaccttaagactcttcatggatattactaagagtttagtgccttttatttaaaagatatcatatataactaattccccaatttaatttaaaatttatttcacattttttgtttataaattggatgacaaaagccagatttttctctttgttttttattactgtcttgtcggtttcacatgaacctcatcctctgccaacgtattttgtgtatttttgtcaactctgataagaccgtggatatgataacaggatattttctgaaccctcagacacatagcccactatatgtacattggagcgacttggattgaaactgatcattgctgtgggccaggaaaaacaggaatacattttaggccgaagatcatatgacagtctgaacacaatatttgaagtatttggagggtgtagcaacagacaaaattttgtaaggtattctgtgcagatatttagcattgggtgcccaatatgaggtcacacaaattctgataggtggataaactgtaaaagtcacttagggtcagatgatattgagagaggaagcagaggtgccttaagcagcatataggcaggcagagctccagtgagaagcgccaatgtggaaaaagcatttatgaagcagaacctatgcttacaggaatgtaggacacaggcagactgtcagattagaggctcagacacagaaggaggcatcggtttaattagagatgcatccaagaaccaggtttagggaaagtaagtggcttggattttgacattgaatcacaatagcagaaacaaaccagcagcaggatgccctcattgtgagtctcagaaagcggatggctttacctgctttagacggacagggtagtttctggaaactggaacccgaattggctggcaatgctggagatgccccaattatacacagagatgcattctgggctagggctaggtagggcattggtcatttacagagttcaaggtgacccaattaaaggatccgggtcacagtgaatatccatggaagaccaacagaaggacacagggcatatgcaggtgaagagaaatgaggacccggagctaaaggaaaaaacacaacatttacttatttcacaatttgtttaaaagataaactgatttattataaaaaataaactaagcacttaaatctaacaaagttactttacttccttatctaaaagtaatctgtatgtgctcatttcttcggttctattcccccaaaatgagtggtctacctcaaactttactattcccaggtcactactgaaacaattatcctacgaattcttattgagtacaacatggtgacattcagttgtggagaaagaaaagttgatttctaacagacattaaactgatattatgttaataaaaagatgtgtatgttaagaggaaaattaacttgtaaactcagaattttctgtgctataaaaaagatagtattgtaggccggacgaggtggctcatgcctgtaatcccagcactttgggaggccgaggtgggcagatcacaaggtcacgagatcgagaccatcctggttaacatggtgaaaccccatctctacaaaaaattagccagatgtggtggtgggtgcctgtagtcccagctactcgggaggctgaggcaggagaatggcgtgaacctgggaggcggagcttacagtgagcagagatcctgccactgcacactccagcctgggtgacagagagagtctctttcaaaaaaaaaaaaagatggtattgtaaagatgtcaagtgttaatgccaatgatgagacaggaggatgactctgcacgtgtttctgtgattgaatccttgccaacctttccacttgtttttattttttgtcttttttttttccttttagtggagagtagggtcttgctctattgcccaggcaggtcttgagctcctgggctcatgctatcctcccacctcttcctccctaagagccgagattacaggcatgagcaaaactttcctatcaatgtatcaagacatagccatacatttttataaacttacaccttgtaagaatcctgaaaaggcatttttacacttctgctataagaaaagaaagcctataaaatattcttcaatagaatgattttcagtggaaatatcacaatagatgaggcagtctaagcaattccaatacaatagggagacaggctgcctgagagtacctaagaggaaatttattatgaaacaaggtgggcattttacaaggagggaagacatccccatctctgggaatgcaaacatacaattcctggtttacgttagaaagttttacttttatgtgtctattttaagcttgaaaacaaatgtgtaacaactgtaaaacataaggcacttggggccaaacgtgacaacattcaggagagggcaagtttgggatgtgtctttgtagcacggtagtgctctgaaaccgaaacacctcataccttcgtctgtttcaaggtgaggctaccctaaaaacaggacataaatcttcatccatttctcaaagggaggaaggtggaaggtaccacgatgaccattgtaagaaaagacagtgacacaagatgatgcttaattgatgtactcaatgtcaaaaagcaaatcagaggtagaggtgggcatatattccagtctcttacagtttaatatgatgttttatcatccttgctaactgaccaacatgtatatcatcgcgaagacggaactgtcagtgtatgatgttgtcgaacgtcccactgaaaccattctgtgcttggattctgtgggaagaagccaagcattctgtggctgtaatgggagatttgtttaataagggtctgtgatcacccgggtgaccgctgtcatgccctcaaatcctacagaggtcatgtcagtctaggaccagcttttccattgatttgaataatttcctgcaaggtttagttttgccaattattttttcttatttgcataatgaattattctttatattttgtgatgatctgatagtggattcacattgttatttactttcatttttgggtttttgttttgtttttgtttttgtttttgtttgagacggagcctcactctgtcgcccaggctggagtgcagtggtacagtctcggctcactgcaacctctgcctcccgggttcaagcaattcccttgcctcagcttcccgagtagctgggattataggcgcctgccaccatgcccagctaacttctgtatttttagtagagacggggtttcaccacgctgagcaggctggtctcaaactcctgacctcaggccatttgcccgcctcggcctcccaaagtgctgggattacaggcgtgagccagcatgcccaggcgaccttgttatttactttcatcaagtggaactaattgaggaataagttgttggccaccagtacttggagaaagacaaaaggacctagaggaggatgacataaataatgtaattatgaggatccaactcaaggcttacgacttaagtgtgaaataaaatgaaggccaacagatggtatcatcaaatgctataaaatctaaaatgttatgataggagcgatgacagaatattttcccattcttctctaggggtaataaaaagtgattgtgattgtattagtcagtcatggatgcattgcatttgcaaggttcatttgtaggaagttaaacagcctggagacctggacaccgtctcaggaagaaaacactgggtaaggggtcacaggtcatgctgttgctgattttgatttttgttatgtaggtcatttttaatgatgtcgttaaaagaaaaaatgttctaaaatcgattcagattcaaaattgttatttttctctgctccacaaattctgacataaaaacatttgaagcctatttgtatttctacaacaaatgcttttttttttcttttaaaccaagtaaaaatttcagaaaacactgatatgaaaataatcctgtcaattaaattccagtgccaggcaactagaccgaggaacatgaaaacataccaaggcaattgggaatattgagcttgaaatctgcaaagatctgaagtgatacaattagcaccattcaatagtaaatgccaagattgaacactcaccgtcagatattttaaaaatgatggaaggtggggtgaaggaaacgccccgtcctgggtctctggggttagatgtgggcctattttaacagtgacgaaaagtggggtgaaggaaactcactctactgggtctctggggtggggtgtgggcctattttaacaatgatgaaaggtggggggaaggaaactcccactcctgggtccctgggggttagatgtgtgtctattttaacagtgacgaatggtggggggaagaaactccccctcctgggtctctgggggttgaatgtgtgtctattttaacagtgaagaatggtggggggaaggaaactcccactcctgggtctctgaggattaggtgtgggcctattttaacagtgaccaaaggtagggggaaggaaacgccccttcctgggtccctggggattagatgtgtgtctattttaacagtgacgactagtggggtgaaggaaactccccctcctgggtctcaggggttaggtgtggcctattttaacaacgatgaaaggtggggtgaaggaaactccccctcccgggtctctggggttgggtgtgtgtctattttaacaacaatgaaaggtggggtgaaggaaactccccctcccgagtctctgggtgttagatgtgtgtctattttaaccatgatgaaaggtggggtgaaggaaactcccccacctgggtctctggggttgggtgtgtgtctattttaacaatgatgaaaggtggggtgaaggaaactccccctcctgggtctctgggggttagatgtgtgtctattttaacaatgatgaaaggtggggtgaaggaaactccccctcctgggtctctggggttagatgtgtgtctattttaacaatgatgaaaggtggggtgaaggaaactccccctcctgggtctctgggtgttagatgtgtgtctgttttaacaatgatgaatggtggggtgaaggaaactccccctcctgggtctctggggttggatgtgggcctattttaacaatgatgaaaggtggggtgaaggaaattccctcctgggtctctggggttggatgtgggcctcttggctctgctacttacctgctgcttcatctgtcatatcccaggtcatgtgtttcttctgtaaacacaacgttgtttttgaaaactcttagtactgaaatgctataaaatttttttaaaaaatcaaagagtattttaactgttggagagtgtttaaagttttcttttgatggttttaggcaagtttcccttttaactccttctaaaaatggtgtgagtaagatcatgggtgtggagtatgtgagagagagagagaggggttcagaatggaccagcgtttctggctttgatgactattagtgacttgggaaaatggggaagggtagattattgaaggtaaaaataaatagagataaaattttatttagaggtaagacttgggaaaatggggaagggtagattattgaaggtaaaaatagagagaggtaagattttattaagggtgcaagaatgttgaggtcccttgtcatttgtgttaggtttttaatcttgctgtgatgtgaaccatagattatagatgcccacgaagttagaagttgcccattggacatcatacaacctactaataagacaatgttagacaaaaacacaatgttagaggtggaaagataaatgacagatgtttttaaaactgcataatttataggacagtgatgacttgaattgtaaatgagatgaagaaaggaataaaccatgactgtgaggtttaggttctgatgaggaaggcttcagtgtcattaagttccataggaaaacaaaaacaaaaacaaaaaaaagcaaaaaacaattcagagacttatctaggaatcacagcacttcctaagtcaggcatttgccattatgttaaccagaaatcaatttcctttgttaagaataaggaaatgattttgtaagcagactggacaggagaaatgcctccttggtgatgtttgaggtttgcgggttaagtacgggtactcgtgatatgccctggatgggcaaccttgccccactggctgtggactccactgccatgaagtctgacacctccataatgcaaccacacctggaggccaggtgaccaggggcgtccctacaactttggtcactttactggaacctggtgcattatacattctggccaatgaaaccaactgagggaacaagacaagaaagttccataggtagttatgtatgtgcatggattagctctctcttctggaaacttccagaacccttaaggcaatttagcgtaaaacaagatctatatgaaataggcctatttggaagaagaaattctttatctgtgctcttagtacaagatttgaaggaaatactaagaaattgctcattcttatatatgttcttattaatttgaatgttcagtcatttaactaatactgtaaaatgtaacagacctaaaggaataaaatggctctaagtgaaaatataaaaataaaatgattcatcaggaggtgaaggaaaatgttccgctcctgctggaaatctgtgctgttattcatgttcctggccatgaaatgtattgaatatatttgtcagttcatttatcatcctcaaactcattatgaccaaaataacagtatttggtattcataacactgaagatgtctgcactgactttcatatattatgtaaaataatccatggaaatgtttattatgtaaatacgtcaccacacatttccacactgatatgtaatgaaagctgatggaattccctcttcagaaaaacactttatgaaactgtgtaggttccattttaggtttgctaaataatactgaatccattctgaaattcccctaattgcatatttctggttgagtgctatttttaaatcctcccaaattttgtacaaatcagaaagtgttaaaatttgaaacacatttattttcacgattttgaaaatcagctcacttatttttatttagaaaatacagttaactttgtgtttttataacactttgaaatcactagaagcttactactttatttgaatcaaaagcacttacagacacattgtctagaattaaaataagcaccagttaaatatagtaatatgcatacatttcactgtttccactttcactgccagactcagaggatacagtaaacaatgcatgttctctgggctacccgtgcgttcagggaggttcatttctagacgaagtaatggggtatttgcatggggaaacttggaagaattagatacacgcagagcacctgtcattgcctacttgtggtgggattcacaggaaattcagggaggaggaagagccttcaggaggaatatgcagggtagggtaggacagctgcagccgtaagggagcttgatcttaaagggcagggaggatctggacaatactacggcacaaagcatcatgagccctggtgcagagggcatcaccagatggcaggatccttagaagactgggaccagggtgaatactcaccatggtgtcttggcgacccgttagtcagcaacaacagcaatcttgtgtgcagtgaggaaggcttagactaagcactggaagcttagaaagcaaaggattcgacccacctgatggtgggtgcagggggctttgcacgccttcggtggctaggttgacaggagcagtggaaagaagggaggcaaaggtggaagagattgagagttgcgtgtctttcagatgaactgggaaatacaaaagcgaggccatttttggggaagagatggaactcacggcctttatttccaaaaatgttggttacgtactccattttgctttgtatttgtattttgctactgaacgctttacggtcagtgaggtgcagaatatgcatgtcaggggcaaaagtgtgcggcaagcaggcgttgtatccccataggcaggatgaccctgcgccctcgctctgcaggcgggtggcttaggttattaatgcctcaggaataagcccagagaggatgggctggcacctgcaagccacagttaggctgatggatggcagtcacccactcagcagaaattctttcaaagaatgagatatggaaaaggaggaactgcgctcttgcgtcccaatgcagcggtggtctagttgaggctgtcacttctctggaattgaccacctggctccactgctcaaggtgttgaattcttacatatggtgggacaatttctttgtatttattagttgtagaataaaaaaagtatcagcctatgagtcataacagcagcaacaaattcaggtattgttgataatcccttatatttacatggattttacttgtacgaggagcttatcgtgttttcataaatcctttagtttttcttgtaaaaatcgctacagcatgggggagccaagcaataagcagtgcccttcacagctaagatgtgaaggaggcacgaggcaggggcagggtgtgtgagggctgagtccgggacagaatttgggaagaactcagttgtctcccatttcttctcatcctccgtccctctccaaactagtgccagggccacgggccccactgcttagttggactcttataatcgtcattattttgtaggtgattttcaggattatatgggacagcacagacaaacctgcctgatgaattgtgtggcacagagcatgtcttctgtgtgcgctggtggcagcccctctatgctggagttcatggtagtgatgaggttctgggccagacactcctgaagttggggcccggtctattcacttggtttctaagccactggtagagacttaagtctaaggtgataacaataaattaaccagagctgctatttctccattaaaataaaagtttttttaatgagtcatcaatttgatattcccatctaagagcaaataaatataaatataagcattactgagatttagacaatgaaaattaaaattatgtgctgagaaacctacactactaatgaagaattactttaaaaatagcccggctgacgtgttcctaatgttcttctgacacttttcttaccatttttatcaatttagtttttcttcagcaatcaggcaaaaaaaaacaaataatctgagaattctcccatctttaaaaataatcatataattcaatttcacagaaactctcatgtttctttttaaaagttattgttgaatgtgtgcggaagtgtttgaaagcatagaattatatttcaatataatttagatacattttaattatggtatttgggatatattggtagaactatcttttacttgccacctttttctatatattggctctatattaatatttaattactcaagctatcaaactctgttttcaattatgtttaatttgaatcttatattgactgacataaaattataccaaattctttgtgtattgcaaatattttcatttgtactttgccatgaagactctgcagtggttctaatccctgtggttaaatcctaaagaaccaacactagttaatcaaatgctcgggatagtcaagatatttttaagcaattagtagtttttggagctaaaaacagaaatatgtgagtttcatttttttgaccatttattcctagattttttttaaaagctaggccttttcagcaaggaagttacttcttcagttattatctggatgcaagacacataaacatccccagtttgttttgcagtatgttctgaggataatcaaattccattctgtgtaagggagtgatccataggaatggctgaatctgtgttgttgtgtttctgggtctccctttgtataaatgcacatatgtgtgtgtgtttgtatgtttttattatttgtaaagctgaaagcagcacctgccatcaagcatgacctgtgttagtttacagtcacccacctgccccgtggaaagcacagggggctcctttggaagcagctgcatttatttcttggtgtgtggctgtctgtgtgtgtgggctgccctgtgctcggatctggcttccacagaaaccctgcagaaggaaccgtgacactccagctagggaactcctgtgaccaccacccaaaaagcaaatgctttcttactctcgtcatgcacctgctataatacctccaattaaactctgagtcccaaagggcaaaaccatgcttatacattgaaacacagcattgtgtcacgaaagatactgcatattaagcgcttaataagtatgtgttgaattaatgaatgggcatccttttaatagggaatatgttaacttttatatgttatcttttatctacacagactatgagtttctggtgagcaaggactgaggtcagttaattttgtatcttcggcgtctagcaaaatatctgaagccgagcaggcacttcatatgctaagtgattgcattaatgaatcaatgcggtaggccagaggatatgctactccagatttatgttctcaattagagaactacagagattttctattttttcattacttttttcattttaacacctattaaaaaattggaacaaaagcaaaacattatagtaagaagttatactatgaaagatatttcataaataaaaatagaatattacaagcctaaggtactatatataatttactagcttcatcatcaggaaagaaatcataattaaaaataaattcagggagaaggccaaatgtgataggtcacgcttgtaatcccaacattttgggaggccaaggtgggcagatcacttgaacccagggttttgagcccagccggggaaaccctgtctctacaaaagatacaaatattagctgggcatggtggcccacatctgtggtcccagctactcaataggctaaggtgggaggatcgcttgagcctgctaggtcaaggctgtagtgagccaagatggcgccactgcactccagcctgggtcacagagcaagaccttgtctcaaaaaataacattaaaagttcacttatacagtagcaactttattttacatgaaattttactaaacacaaaatttataacattttaaagttaaaatgtgtacaaggcatgatattgtgaacacatcaagtaatgataccaaataaacgtagtattaaccagataactgtaggctggttctacctgacaaaaggagccatccttacacaatcacacagaagttcctattaaacaaaacaaaacaaaattaagtcattctgggctttttattttttaactattcaccccttgctatacaaagaagtgagtacaacaaaacaaacacttaattgggaaaaaatagaaaacgtaatagaaaacaggcaccagaacaacagagaatacaagtccacacttgtgtgattgagtgtcaatgttgactcatactgtctatgcctatagcttgggtaattattgcgattactatttgttaggatgtctaatttccctgtgaaactccataaggactgagattgtctcgctctgtgctcctcatgctcctaacatatccaaagcatgtttatttttaattatttcataacaggtgttatcaatgaaagatgtattccttttctgggttaatacaggggatctgctatgagaagatcagaatcattatgtgacaacaatgctgatgattctcctcttcctccctcacctctcccatgagctgcatttttctctggtgtcctctcttcatcacagaccccatctatcatctactgagtcttctgtgtccactctcactcaggctcaatttgcaaaatagtatttgtgcatgcttcatccacgcacacactcttgcctcatcccctccccacatccactgacacaggctcctttccagcactaaataaatacttttgcagattttcctgcttgtcctttctttcttctcacccatgtccatattgcacattgcttctgattatctctctgaaatacgaatatacttgtgtcagtttcctgtgcagtcttctccgttgccttccccccactgcacgctgagttggtctccactccttggtgctgcagccgagtcctttccagtctttcccgtgacctttcctgtcttcccttcaatccctgtctccatcacaaccgccacacgtttaaaaggaagcatcagcatatacaaatgttcctgtaaattggtgttcccaactgccatgcgatttgaagccttttccacctggactgttctccctctgagtggatggcgtccaggaggcccctagacctgctcaaaccctctcccgcaaggctcactgaacccctccagctaccaatatactagtttcctttgtccctctcaaccttcacgcaaaccatagcattcatcgtgttgttttataagtatttatttcctatctgtcattcattagacaggggaagataggagccgttttattttactcttcccaccatgccccaaaaaagttcctgatagatttgaaaacattttttttacagctcattattttcctttatttttattggcaagtaattattacacatattcatggggcacagggcacatggtgatgttacaatacatacagtatatagttagcacctaattgtaagttcttaccaccttgtacaagttagaacaatatttgccaactggatgtatttaaagatgaatttagagtgaaattatttcagttcatccatgtaggtgcctgatcctggtcttgccccaagttcccccactctgagttttaaatatcctcaacagagaacatacgtgcatagtggtaaaaaaatcagtgagaaagtgaataatttgaattatttcactgagacgtctcagaattgatattaactatttgacctgctggaagctctgcacaagatcaaagtacaaccagcattaaattcacttgggattaatgtaatgtatttaaaattataaaatgtttcaagattgactcattaaattcttaggtatgattaacttgctttatgatttattaaaagtttgcttgataaaaaataagacagttccaaaaaatagataatttggctatctgattttcattctggacatttacaggctttttgatgttttaccttaagttcagaagtttacatttctgtttaaacattgtcaacaacctgtttgctattgctattttttaaaaatgtggagtatcttaccatggggctgctcataggattacaaaataatgtcagcaaaaacttaatatatgggaaaaattgaatgaattaaatgaaaatagtagctaacaagaggactcaatttgaaaacaatagcatctgtagcttaaaaaaccataaataatttaaaagatagtttaaaaatcacacacacacacacacacacacactcacttcacctagaatttcattcttgaataaagagagatgtattgtaaaacatggaacaatcacacatttcaggaaataatcacacatttcaggaaattcattattaatgaactttccttctcaagtgaactataaaaaataaatttaaccaattacctttgaaactcccttcctattcagatgaatccaaatagagttaataaaaagcaatattaagtttttaatgcagttctttacactgaaggaaatggtgtgaaaacactgtccctttttttcacatgagagtcattcttaaagagatttttgccaaagaagtacattatcccaattgaaatgtcttaggtaaaattaacagatagatagtatgtttttgtaaatacttcaagcttttttcagttgctcatgagaaaatatatcagagattcaaaaatgaccagtattccttttcttcagttatgttttcagagctcacctgagcatgaaactactttctcaagagttgctcagatagaagctgaaaaaactcacattactgtgagctcgttgttcagcctaatgtataaaatggattaagtctggagccggttctcttgaaacacaagtgctttatttggaagataagaactaatccgaatacttgaaagctaaaagcaagtctcatagaactctaatattgttagaagatacataggatttaattcttaagaatattaagactgcgtaattcatgcaacatatatggagaagtaattttcatcagctgaatgtttggagcttgttttgattagaacattttgttcgtagtattttggctgtgctttgacttaaaatgaaatcactagaaaacaaagaaatagaattactaaatacattcaagttttgattgtaataatacttaatagtgctttgacacaaataatgtgatttagtcttttttaaagtttctagagcataaagcaaatacagaaccagtatttgtgccctgaataattgcagactagtggcttcaagatagaaaaggataccttctgtatgtttttaaagttactactcttcagcaggcttaaaattgatcagtcaaaagtctcttaaattcacattaaaatggaaatatctctatttggaagaatatctttgtagaattaaacatatcctttaaaaacttgagatttattttttatttttttattatactttaagttttagggtttgttacatatgtatacatgtgccatgttggtgtgctgcacccattaactagtcatttaacattaggtatatctcctaatgctatccctccccactccccccaccccacaacaggctccggtgtgtgatgttccccttcctgtgtccatgtgttctcattgttcaattcccacctatgagtgagaacatgaggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaaatctttgctattgtgaatagtgccgctataaacatacgtgtgcatgtttccttatagaagcatgatttataatcctttgagtatatacccagtaatgggatggctgggtcaaatggtatttctagttctagatccctgaggaatggccacactgacttccacaatggttgaactcgtttacagtcccaccaacagtgtgaaagtgttcctatttctccacatcctctccagcacctgttgtttcctgactttttaatgattgattgcttgccattctaactcgtgtgagatagtatcttattgtggttttgatttgcatttctctgatggccagtgatgatgagcattttttcatgtgtcttttggctgcataaatgtcatcttttgagaggtgtctgttcacatccttcacccactttttgatggggttgtttttttcttgtaaatttgagttcattgtagattgtgcatattagccctttgtcagatgagtagattgcaaaaattttctccctttctgtatgttgcctgttcactctgatggtggtttcttttgctgtgcagaacctcgttagtttaatccgatcccatttgtcaattttgggttttgttgccattgcttttggtgttttagacatgaagtctttgcccatgcctatgtcctgaatggtattgcctaggttttcttctagagtttttatggttttaggtctaacatttaagtctttaatccatctgagatttcttaaaacatggaaacattcttttctgaaatagtgcagaattaacatcatagaattttatgttgtcatttcagaattctcctattacacatcaacttattttaccaatattcaaaaacagtgttgacatttttaggaaacaatgattatattctagtctttaaacacacagcaagtaaagctcaattgaaatgtacttcatgcaatttgcagagagggaaacagcaggctaggctgtatcctaacgaatgtggataaagtaacagcctaggggtcaaagtgtctgaaacaccagattgaagtctaactgcctttgagaacctgagagatgctgacatgctatggctctaagggcacagtttaacggtggaggcagcactcttctccctagcaggcgactaagctggttcacggcgcaagtgacacgaagtagaagcttcagatttctagggatgtttctctagtccttcaaggtattgatggctgtgattccaatgctacttcccattgtaaaggcctatgattctcccagcaactgtgtgtgaaccatcaaatcctgcgaggagctttgagagaacaaagctctcttcagtctactgaaaattggaaaactgatctctagaatggccaaatactttcaactttctgacaggaaagaggaatgtattttataaaaagacatcacacaagcctagaggctttaagttatagagctttttacaagataataaatttaatgatgctgtcaaggtcttaagtgatcttttgcaaaaacaagaaaaggcatcagaaaaaaaggagacagctggtcatataaagagaaaactacgctgccataaataacttggcttaattcttctgtatgacaaggtgtagtttaagcagaaagaaaaacttttgatattgaatgattgatagaaaaagcaataaaacatatttctgtacaaaatgcaacccaagtaaagtttagtagacattttaatggatacatcttttttctttgcttgttttttttggagaagagtggaaagaaacattacaaaacaaagctttaatgcaagttttagggtagaggaaaatgtttcttcttaaactaattttaaaataagcctatttttggattttagaactttgttaaccttttttgattgaagtctttaaaagccatgatttctgaacatagaggcatattctggataacgtttaaagcattaatagctataaactacttgtagagcttatggctataaactactgaaacaatttgtaagtcccacaggaaaatgaatgttattacacatgtctccagtgaagaaaatctcttatgattgataaacgcttctgtacaatcagaacataatttattgtcaaaatgaacacagcccacaacttatgatggttcacttacaatttttcaactttataatgatgtaaaagtaatacacgttcagtagaaagtatactttgggcacccatgcaaccatctgtttttcatttcctgtacagtattcaatactagcacaaatcgtctagcataaagcttgttttgtaagaaagtgttgactctctagctgattagactcatgcttataattccagcactttcggagaccgaggcaagcaaatcacttgaggtcaggagtttgagacaagcctagacaacgtggtgaaaccctgactctactaaaaatacaaaaattagctgggtgtgatggctcgcacttatagtcccagctattcaggaggctgaggcaggagaatcactggaacccaggagatggaggttgcagtgagccgagatcatgccactgcattccagcctgggcaacagacagactgcatttccaaaaaaaaaagttgtttgttattagtagtggggaggactatctcatgtcaacaatttcttataaaataaataggctttgtgctagatgattttccacaactataggccaaggtaactgtcctaagcatatttatggtaagctaggtgaatttaagacatttggaaagttagttaggtatattacattaattttctgcttaaggtatttcccactcttaatgggtttattgggacgtaacctcatttgttaagttgagcagcctgtgtaggcatcttgaccacttcttagtccaggctttcatcatccccagcagatgtgtttcaaagctcagtttagaagcattacgtgcaatattccacctctttttaaaaactttttttaaaactccagatttcttttgccccttgaaaaacgagaagttcgggtcacattgggtgtggtttgttaaggtggatacctcctgggtgctgtgtgcagaaccccacagtttcctggccccgctgccattcacagctttgttcttcacggacaggacctggatgccctgttagcatgggcggccctcacccctcaaaaagatttttaagttttcccaggatcctgttccagtggtactgatcatagggatagatgctgaactcaaaagttttttacaccccgattttgtgtgcctaatggttatttccaattgtatgttccaatgacattggataagcagcatacctaatgtaaattcaagatagcgcaagattttggaagattgtttgttattaatagggaggtggactccaagtgtggccagggagaatcatcacctccaacaagtcattctgcctctagtttgctggtggtcatccccaatgctgggcaggactgccttctaaagacttgttcagatgctgtcacttccaaacccgcaaacccagtaacactacaacaataacaacagtaaagacttctgcttcttttttcctctctgcgaaaacagaaatgagcactgaataatctgtaataatgatggattttgtcatacatgatattgaatgtcttcctttctgccctgtcttcttggcattatgcagtgagatgaaggtcatcaaatatttgaatgaccctgaaaccggaggtgattgattgaaaccatccccctaatttctacctcccctttgtggacatttagcatatccctttgttttgcaccaagatggatacactcttctgttcttgaattccaggcatctgaattaaaattattggtgtctcttaaatagatcagggttatcgtaaaaataataatgtcatggttggtaaagactgactctttgtggaaggaaactttatggaaggaaattttcttagtcactgagtgcaaaggatcaagcatgtcctctttctcctatacaaagctgcaaatctcaatcctgattagtcagacatcagcagggtaaaattatattgtgaagttaagaatacattttcctcaatggaagggcatctcagacttcacattgacaggaggatgtagcagaagtcacaaattcatttcaaaatttaatttctttttgagaaaagaaagcattcaaagtttggtggaaatagaaggaaagagaccatgtggtccctcaagtttccagctctcccttttacaattgtcaaaatttgcatcatgatatgaatagaaatatgttactgtaagactgtctttcacagatggccttaaaatattgcctcacataaaaggaatatacagctctcagtactgcagaagctaaatcttcatttctgtcatctatttctttgagtttaagagcttattttgatgaggtcattataatgattcatttctggagtttctgttgttgtgtggatttcctcaagagcctcataaccatgcaccatcaggagtgtggtcggcagtaattcaggagcgccagtttttttttcttttcccatgaagttgacatcttggagtttggaagaagttgtcgggaaggtgggcgggtcttgacaatgggctggaataagtgctggctgtcaggattctgcaaagcaccctggcagtgccgataggtggcccctcttccttggaggtctaggttgtgacagaggggcaaagaggcagcagagtatcccgttcctagaggtcctagagggcattggggctcaccagagaatccagggtgcagactggaggcttggactgacagatgaagttgtggaactccggaaaacaagagcttgaggggccgggcgcagtggctcacgcctgtaatcccagcactttgggaggctgagggggtggattgcctgaagtcaggtattcgagaccagcctggccaacatagtgaaaccccgtctctactaaaaatacaaaaaattagctggacatggtggcaggcacctgtaatcccagctacctgggaggctgaggcaggagaatcacttgaacctgggaggtggaggttgcagtgaggcaagatcacgccattgcactccagcctgggcaacaaaagcaaaaaaaaaaaaaaaaaaaaacttgtaagtagggaggaacaaataagatgaccgaacttcaagaaatcacaaatgggtaacaaatagccccagtacagacccatctttcttttcccctttgtaaattcacaatctccttttttctccctacccttcaaggagcatttagcaaccttgtttgtttcatctctgttttaaggcagatgtccacccttgagttctgttcattccttgcctttctctcttgcaggttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcataggtgagtgtggaagcagtcataccattgtgcaaaagccaggccttagggtgcttgcaccatgttgcattgacttcctttattggaaaagaggaggaattttatcacactttccagtgtgagttttatgtattctgagatttgcacgtgtctgtgagtgtgtgttttcagctatgaaagacagtttttctagtattctgttatggagactataggtacagtgttattattagaattatcacatattattagaattatcacatgagtgtcttattgctttatgctctcaactttaattgcatggaggataaagactttccacagaggtaatgatttggaagaaatattgaaacggtcaggagagagagatgatggtgattctttttctctatgtatataatgcagacataatggctttggttttgaaaagtagctaaatagaaacatgtgatgcctgaagctgaacgttcccatctctctgtgtcttctacagcggaatgtggtggtcagatccatgcagccacatcaggacgaatattgtcccctggctatccagctccgtatgacaacaacctccactgcacctggattatagaggcagacccaggaaagaccattaggtacttgttttattttggtttcagtgatttgagaaaagagatatgccttctattcttgtagcagagatagtggtacaccaaatatccatggttaaagtttctgaactaaagaagaaaaggtaaagctgtagctaaaagttttgttggctcacttgcttactttgctgttgccttgaaaccattaattaagttctatatagtaaagccaaaatgagagtgtatcagttagcttctgctgcataacaaactatcccccaaatttagtagctgaaaaaaaacatcatgacttcgtgggttgcctgggctgttctgatctgcgtgagactgcctggggatgagcagtccaggatgaccttccttaggtgtgagggcctcagctgggatggttgggaaagcaggagcccctgcacaccaggcttctgttcctgcagcaggctagtcacggtgggagggttgtagcagcaagggatgaacaaatttccaacttgtgcttacattacacttgctaaggtgccctttgtcaaagcaagtctcatgggctaggcaagactcaagatatgaagaaatacactctactgttcttttaataggaagagaagcaaagtcatattttaaaaagacttgtgtgcagggatgggagcaatgtgtgtcattttgcaattataccaaagtaactttgaggtagaccaagaaagtactctaaagtaacacatataaaagaaaatcattgcaaatttcagaaaatgatgtgaacatttaaacaaaaagtgttctattccaatagtgagttctgagttatgatgatgagttatttaaaccaacaaaaagtaatatttttaaagtaagctctgtaatatttttaaagtaagctcttggtgatctactcagaaatctgtctccaaaaccatagcacataaggcaaaaggtaattttaaaatcagttttatttttagttcttgtttaaaatgaagtggacacacagtcctaaccaatcctttttaaaatgtatttttccttcaattaacctttctgtttcattgttgttattaattttctgtacaaaatttgcttttgagaaactctgacctccaatagccttaatctgcatgtcccaggcgtctacactccatcatgctattatacccacaaaagactaaatgaatcagcccagctgcttcagctcctcctacacatacgtgaagctgaaaaaaagttacaggtcaaagtcaggctgggcacagtggctcatgcctaacactttgggaggccgaggtgggtggatcacttaagatcagtagttcgagatcagcctggccagcatggcaaaactccatcaccactaaaaatacaaaaagcatctgggcatggtggcacacacctgtaatcccagctactcaggatactgaggcagaagatgtggaaggatgaaaaatatttataaacaaatgatttttgtccttattcagaaaagccaccctatcaagcttagtaatgtgtattacacatagatatcatacacttacttcactgcaaccctataacttaacaaaaataaaatgggatgaagtggagtgaggaaaatgcatattatacaccctacatgagaaaggttctccctacataaaaggagcaagaacaacaattaaagcatatctagaatgcaaacatcttaggatggtgtttctgctgctacaatagaatattacagactgtggggccgggtgcagtggctcatgcctgtaatcccagcaccttgggaggccaaggcaggcaaatcaccaggtgaggagatcaagatcatcctggctaacatggtgaaaccccttctctactaaaaatacaaaaaaattagccacacgtggtggcaggcacctgtagtcccagctactcgggaggctgaggcaggagaatggtgtgaacccaggaggtggagcctgcagtgagctgagatcgtgccactgtactccaacctgggcaacagtgagactgtgtctcaagaaaaagaatattacagacttagtaagttaagaagtttagtttcttaacagttctggaggatgggaagtccaagggcatggcattggcagatgatgagtccacatggtgagagcatcacatagcaaggaagtacactagagacagagaggaaatggggccaagcttaaccttttatcaggggctccctcccactatagctaacccactcccatgataacagcattaatcccttcatgagggcccagcccttatgacctaatcacctcataagggctcccactttcaatatggctacaatggcaattaaatttcaacatgagttttggtggagacagtaaaaccatagcacatactattttataataactcattttaaaattaatcaagataaatgattaatttgatgattattgatctgttgggacaacactaagttatagctgagtaacagaatttaatatttcatattcctcatgaaaatctatgaaggcatgtttctatggaaataaataggccaggcatagcggctcacacctgtcatcccagcactttctttgaggggatgaagcaagaggatgtcttgagcccagttggtcaaggctgaagtaagctatgatcacaccactgcagtcttaagtaaataaattaattaaattaaatattagtccttaactttgaattcacaaatgctagatttgagtaatgtaaaaaccacttccaatggctttgattttgaaaagttgtagaaatcatctatgctaatggaatgactttatataaaaataatttatcttcttttagaagaatttcacatttttgtttttcttaaaatttcctttgtggcttaatttactggaattaattagagtgagcattgtctttctctaaatgcaaaccaagtcatggattcactctttacaggtgaatctaatactttgttaacattttaataaaaaaaattaaaaagagaaaaataaaaaaatatttgaataaaaacgtgcagtttttattgcatgaactgaccttgaaaaattttcttcgtatacgtatatttcaatatgaggtacacactatcaaatttataaatacatctattaaatttaaagcataaacttcttcccaataagcagcttaagagggtagccatccatgtttatccttaatttcctcaattgacaatcaacttaatcccaaaatgtttttgatgattgaaccactcttcatgaataacataaatgcaatttttagtatggtgatctggcaaaaccataattagaagtacataatatactaaaattgtatatcatgtacttaaaattgtactaatactcagaaaaaatggtgtctggtcttagccttgatattagcttgcatggttactaagtcttatttatttcaatggtaacatagtctgtattacctacaatgttaacttgaaaatgagaaatacatcagtcatataaatatgaacacagggattaatttagctctttaaaatatcttaatataaatgtaatcattactatgcatttatactatgatatcttaatgtaaatatttttcactctcaaggaatgaataaacagccggatcttggaaaatatgaaaaggctggtttcaatattttactttaggccaattattgcagagctacattgatttcattgaggcccagagcaacttctgcttatatagtgctattcctctttgtttgaggtaatcgaataccccaaaatagttattataatggggcgcaataccccaaaatagttattattatggggcacttgggtctggaagaatttctaattttaacatgtatgctatagagcagttacctgagccaaatttaattaaaagtctaatcacaagacattgtagaaaatttagccccattgaaagttatttggtaatatttctctaagagatccagcatatttcattgctgggcacagccatgctttgctttatgtaacaaaagtaacagcattataaacttcttcagctagcaacattaaaggctatgttttacataaccatatgtgtacactgttcctaagctttaattgcttttctgccagtgtaattgtctggaaagctcactttgaatgtacttctgttcctaattgttagcagaaaattgcatttggtagtatagttgaagggaattatttttaataagctcgcacagtatgaaaaacattggacgcatatcaaaaaggtatcaaggttgtcaaaagcattcctatgcagacttttagaaaaggtaacatgtggtttgacgaccctggtgttctgctggctgtcctgacctggattttctttctagtggcatcagcttttagagagattagagtgaaattgcactggagatctaggaatattaatccatttctgatcaaccttccagatcccagtaggaaatacacttaagagaaaactatacatttatccccagtctccatgtccagcctctgtacatagaccatgggttggagaattttcctgacaggacagaaaggtatgaggccactcaggaataaaagcatgtccaatttctccattcctatcaacatcactatagacccttcccttagttttcatagacaatacaaagaaataacaatttaagtaatttcagccatgaagtaaaagagttatagaagtctacagtttttccctatgcctatggctgctactccagaccccctttaacctggggctctgggagcagttgctggtcatgggtgaccttaccagacatgtaggagagcctgagtcagaggaaagaaacctgcaaccccactcactttgcaaagttctgactcatattttcagttgccacagattagttaaataacaccagctcccaaccataccactcacatttcagctgccatggtacataaactgtgagaaagtgcatgaaggacaaattctgagctcttcagttcctacatcactatatggataacgaggcacatcatcatcactggtgacagatcacatctcctctttcaacatctgctggtgactgctcacagggtgcctgctattcagtgcattctcagacagcaaagagggtagttgtgttgtcttctttgctcccagtgatcagtgcacttgatgtcttaaaaaacgggaattgcaaagaaggaattgcccagaaaagatagacatgcagggaagaaatgagaagtgatatcatgggaagtgaaactcaaatcacacataaatggaattacaggagaaatagctgaggtgggaacattgccactgctgtgcggagagaccttagataggcagccagggaaactcagccaagaaggacgtaggagtgtaagggaggagatgctgtgatgagaacgatggagatattccagaagaagtgactccagaaaaaaacattaaagaaacttctagagttatttcaggatctgaaaagcacaagagataaaatggtggaagctgatccaaacttccctgacatctctcctcagagctcatcacgtgttcccaactcctcacatttcatcattatttcatcattattgtcatcattccctatttgtgttactgtctccctccaaggggcgggagactttagtcttcagtgttatgctctgctgttgcttatttctcctccctcaatatccaataatttcccacctaaaacaatgaaaataggactgtacagctcatggaattcttttgataaattatatgagatttctttagacgagacactgaaaaaaaagtgcatagaatctgaaaacaaagccctgtcatttctccatctctttatgtttcctttcttcttatccaccattatgaattcccatgactttcctgttactttagtcttctctcaactgaccttcccaaatccatcctttattctctccaatctctcaaataccctcactgtacgttgacaagcaccagctccttacccagaaccataataccctctagaatttggcttagtgcggctttccaggtgtatctttggctgctcatggatactttcgacttcaggacaaagaaagcttgactgatctctgatcatagcctgtgctactgtggtgctctctttacacacactgtcttgagtttctcctcattgactcacctccagtttcttcccatctcttagggctcagcaaaaattcatttttattatcccatccagaaatattctgtgttgttccctgatctcatcatttctcttcatcagttaccttccttctgtactaataatctctgttaatatcatatccacatgtcaagacctccagggcaagtttcactagctcccacacttctgtgagcttcatttctcatttagaccccatctgaagcctcccaaactctcctccctgcccaccacctggttccttcgctgggtagaccctcctaactcaccaggtttccactgaccaccctgcaaacgctgccttgcacccactgctcctaccccaaacaatatggtttgttttattttaaaaatttatgtttatgtctataaaactaatgtctatatagattttgaaaaaattaaaaaaaaacaattgaagaaatcatgtattattcccctatagacatcaatggcaaatgtcttatacgtatcaatgtatattgtgtggtgtggacatgtaccattaaacattgtctctcttgttgcttgtttataccatttctaatttttctttctctttttttttttttttttttttttgagacagagtctcactctgttgtccaggctggagtgcggtggcgcaatcctggctcactgcaacctcagcctcctgggttcaagcaattctcctgcctcagtgtcctgagtagctgggattacatgcatgtgccaccacacccagctaattttttttgtatttttagtagacacggggtttcgccctgttgccaggctagtctcaaactcctgacctccaatgatctgcccgcctcgtcctcccaaagcactgggattagaagcgtgagccaccaggcctggccatttctaatttttcatgttgtacataatgatgtgacaagtagtcttgtaagtaaatctttgcttatatttatataattccttagaataaatgcctaggaaatttgtttgctgggtcaaagggtgtgagcatcctcatatgtcttagtacaagtctttctataaagcagagtcagtcatttcactcgcctgagcttgctataaaaacaaaaactattttgtccactcattatgtgcaggataagctctttggcatggtttatggttaattatttttcttaattttaaaataataaagtgctgcagaaaaaaaaacccctaaatgtagttttctgtaatcttaaacaccaaagaaaactacacttgaaaaggtgatatagctttttaaaattttttctatgcaaatacaaacataaaatgtgatatgttcatttatctttttatttaattattttttacgccatgttattctgaacatttattttgagttaataaacatggccaaatgtttacatccaaatttgtaattttgcctcatcctatttagttaccggatagtattccattgcctgaatgtgccttaatttatttaaactacacccttttggaatattcaggttgtttttaattttttcactgttgtaagtaatgctaccatcctccccgtgtgtcacctccagggcacttttcatgatgaatttctagagctgcatttgctatgtttgcacatttcaatttttatagccattaccaaattgcctctaaaaggagtagatataccaccagcagtacatagaaattgggcgtctctacattctctctgaaactggacaaaggcttttcagtccttaacaatctgtccagaaaaaaaatattccaaacattttattggttatatctgtttatacctttcctatgttgacttttttgacatgtgaatacatttggttagtgacttcctcttctctgtgcacttcacctcccacctgcatttccggttctctcctttccctggattcctttcctgctttctcttggctggacaagagccttcccacactttgtgaggcagaattacacctatgtccgctgtatggtggcgtgcttttatctgccagaccttgggacactgtgcgttggaggatgtgtgcttttcctcacgtgcctgtatctgatatcacagagttccttagcgatgataccacattgcattcctttttttttgagacaaagtgttgctcttgtcccccaggctggagtgcaatagcgtgatcttggctcactgcaacctccacctccagagttcaagcaatgctcctgcctgagcctcctgagtagctgggattacaggtgtctgccaccatgcccagctgatttttatatttttagtagagacagggtttccccatattggccaggctggtctcgaactcctgacctcaggcgatccacccacctcggcctcccaaaatactgggattacaggcgtgagccaccatacctggcttcactccattttttttaacttcctttacctagtggaattgtgtctggcattttgacttttaacaattttacatttgaataaaaaatgactgacacttacctacatttaagttttgttgtatcatattttttgttggagtcatgagacattttccaagatggcaaaactccatggtaccagggtgcatgtttgtttttctgtgtaagcttctcattagcatatagcataaaaactgccatgtggcttgttcacaaaagaaacacccccatgtaaccagaactcagataaagaaagggaaaattatctggactcaggatagacctttgagctctattcaaattgtctcttctccaggacaatcactattaagacttcagaagagttttgccaaatttgaattttatgtaaaagataattgtcgggcacgatggcttacgcctgtaatcctagcactttgggaggctgaggcgggcagattacctgagatcaggagttcaagaccaacctgatcaacatggtgaaactccgtctctattaaaaattaaaaaataagcaagttgtgttggcacacgcctataatcccagctactcgggaggctgaggcagaagaattgcttgagcctgggaggcagaggttgcagtgagccacgatcattccattgcactccagcctggtcaacagatcaagactctgtctaaaaaagagagagagagattgtacagttttattaattatgtgtctcacttcatttcctcaatcttcacacccattgataccgttagatatttcctgatataatttatttatccattctgggtgctgatggacatttggatggttctgatgcagtttggagttaatgcaaactgtgctgcttttaatatgctttgacatgttacctggtgaatgtatgtatgctttttccatgggtatacactgaggccaggaattgctgggtaatggtgaatcctaccttccacagtattaggtgctatcagttttccaaagtggttattcttaccctcactccctgagagggtgtatatgagagaatttcaggaacttcactttctaaccaacaatgggattgattgttttttcattttagccattctactgggggtgtggtacctttttatttgcatttccctgacgactgatcaaggtaaacacttttttatatgtttattggccttttgaatatcctcttttactaattgccagttgaagccttttgcccatttttttatactgaaatgatttcttttgataaacacaggtttttaattccaatgagtcataataatttttactcattttttttctttacggttagcaaatttttaaactatatttaaatgtatgctatgccacaaactttgttaaggttggctttagtgattttgtgtccagattgctagctcctccctccccaaagctatacaaatattatcttaggttttcttctacaaaacttaatttacctttcacatttacatctctattccactggggataaatttttgtgtacagtatggagactgaagtgtcacagatttttgtccacagttaagttcaattgacaatttgctgaagtgatttatttctttattgcactatagtacaaattagtaattaacgagacaactagatctatgcagatctgtttccaaactgtattccatttcatttatctatttgcttatctagtacaaaacctaacttaattcctgatttactttataatacatcttgatacccagtatcataatctagctttgttcttcttcatatagatcactgtgactattcttggccttctgcacttccatatgaatttcagaaacactcttaattttttacaaaagaaattgcctggatttttattgatatcccatgacatcaatagatcattctggggaaaactgacatcttttataatactgaactttctggtccttgatattgtatacctctccatttatttagcttttgtatgatttgtctcaatgatgttttgcagttttctgggtgaaagtcctgcacattttttattagaattatttccagctctaggatgctttctgcttaatggcaaacatatgtgaccaggtacttcagaatccatagtcctcttctattctccacctaagaacttcgaagatttcatccagtcctatagtttataaactatttctttgttgaagacatacatgtttattttctccactctgacttctctctgaaactccaacttacgtgaacagctacctacatacccctccatctatgtctagttgacaacttaaactcaacaggtccaagacagaaactctgattttccccatcccataaacatactgcaccgtttctcagttcactggatgacaactccacttttccagtttctgagggacaaacctacagggccagcacatcctcacctcacgcacacctcttccaagcctgttttctctcccttcaaaacgtatccaggacctgaccagtgcctgggtacctccatattcagctcatctcagcacatacgccactttcttggattactcaaaacgttgacagagtgtcattttccctccatggcatgttgtcaacagagcaagcaagcacggccagttctttaaattgttggtgaggactcctgccttggtatatcatccttaaaatcccgcatcggtgtatcatccttaaaacagcctacaaagccctctgtgcgtaggcacctctctcccaccatccaattcacaacccccattcttctctgctctcagctcttccttcccagtcccccttcctctgttcttgctgcactggctcctggctgtcctcaaatgcggacggtatgccccttacgtggggcttctgcttggctgaattcttacgtctcacaggatgcgacaaacacccttaactccttcaaggctgcaccaaaatctgcctctgccaagatggcttagcctaaccaccccatttaatacttcaggcttccccttcctcccctaagaattagtatcccagtgattcttttcctgtctacttttttatttcttcaattgcatttaccacctactaacattccatattcttcactcatttgttatgggtgctgtggactgcctgtctcttccctgtattattgtggatgctgtggtttgcctatctcttccctgtacaacacgaactccacgaaggcaggactcaacttggcagatgtatgcaaagttcctcgaggtgcactcagtacactcttggtgccgagtaaatgttgaattattgaactaaatcaaaaagggaacgtcttatagatgcaaaatgatgatcaactttatgagtgatcagggaaagtaatttaaacaagacaccattccacaaccatcaaattttctatatatatgtagaactcttagtctgacggtaatcaggtattcctaaagatataataaaacaagggcaatacatacattaccctggaccaaagcagttagaatcccaagggagagcgagttagcaaatctgctttatcatgctggcctagaaagatccttgcatcagtacagtggaatatacagtgcggtaccacgtgtcaaaattaaaatgtagaaacaaactgacctttagtaaggaactacgaaaataaaacacttacagttttaaagtaaattaacaaagttctacctttttttcagtataacggtctctcccataatagtacaaaagcaaattgaggctgggctcagtggctcacacctctaatcccagcactttgggaggccgaggcgggtggatcacaaggtcaggagatcgagaccttcctggctaacacagtgaaaccccgtgtctactaaaaaatacaaaaaaattagccatgtgtggtggtgggcacctgtagtcccagctactcgggaggctgaggcaggagaatggcatgaacccgggtggcagagcttccagtgagccaagatcacaccactgcactccaacctgggcaacaaagcaagactccatctcaaataaaataaaataaataaataaaataaaagcaaattgaaagtgatacaagcacacacatgtcaagtaatatttaatatgtaactactcttaaacacacagagtagtacaatatattgtttaggaatacaaatacacacacatatgaagcttctaaaaatataaatgggatgggtggagccaagatggccaaataggaacagctccagtctacagctcccagcatgaatgacgcagaagacgggcgatttctccatttccaactaaggtaccgggtacatctcactggggagtgtcggaaagtgggtgcaggacaatgggtgcagcccaccaagcgggagccaaagcagggggaggcatcaactcacccaggaagtgcaaggggtcagggaattccctatcctagtcaaagaaaggggtgacagatggcacctggaaaatcgggtcactcccaccctaatactgggcttgcttttccaatggtcttagcaaacggcacaccaggagattatatcccgtgcatgactcagagggtcctacccccacggagcctcactcattgctagcacagcagtcagatcaaactgcaaggctgcagcgaggctgggggaggggcgcccgccattgccaaggcttgaatgactaaaaaaacggcccagaagcttgaactgggtggagcccaccacagctcaaggaagcctgcctgcctctgtagactccacctctgcaggcagggcacagaccaacagaaggcagcagaaacctctgcagacttaaatgtccctgtctgacagctttgaagagcgtagtggatctcccagcacacagcttgagatctcagaacagacagactgcctcctcaagggggtccctgacccctgagtagcctaactgggaggcaccccccagtaggggccaacagacacctcacacggcctggtactctgagacaaaacttccagaggaatgatcagacagcagcatttgctgttcaccaacatctgctgttctgcagtctctgctgctgatacccaggcaaacagggtccggagtgcacctccagcaaactccaacagatgtgcagctgagggtcctgactgttagaaggaaaactaacaaacagaaaggacatccacaccaaaaccccatctgtacgtcatcatcatcaaagaccaaaggtagataaaaccacaaagatggggaaaaaacagagcagaaaaactgcaaactaaaaatcagaacacctctcctcctccaaaggaacacagctcctcaccagcaatggaacaaagctggatggagaatgactttgacaagttgagagaagaaggcttcagatgatcaaactactctgagctacaggaggaagtttgaacccatggcaaagaagttaaaaaccttgtaaaaaaaattaaacgaatggctaactagaataaccaatgcacagaagtccttaaaggacctgatgtagctgaaaaccaaggcacgaggactacgtgacaaatgcacaagcctcagtagccaatacaatcaacaggaagacaaggtatcagtgatggaagatgaaatgaatgaaatgaagcaagaagagaagtttagagaaaaaaagaataaaaagaaacaaacaaagcctccaagaaatatgggactatgtgaaaagaccgaatctacgtctgattggtgtacctaaaagtgacagggagaatggaaccaagttggaaaacactctgcaggatattaaccaggagaaattccccaatctagcaaggcaggccaacattcaaattcaggaaatccagagaacgccacaaagatactcctcgagaagagcaactcaaagacacataattgtcagattcaccaaagttgaaatgaaggaaaaaatgttaaaggcagccagagagaaaggtccggttacccacaaaaggaagcccatcagaccaacagcggatctctcggcaaaaactctacaagccagaagagagtgggggcaatattcaacattcttaaaagaaagaattttcaacccagaatttcatatccagccaaactaagcttcataagtgaaggagaaataaaatactttacacacaagcaaatgctgagagattttgtcaccaccaggcctgccctaaaagacctcctgaaggaagcactaaacatggaaaggaacaaccggtaccagccactgcaaaatcatgccaaaatgtaaagaccatcgagactaggaagaaactgcatcaactaacgagcaaaataaccagctaacatcataatgacaggatcaaattcacacataacaatattaaccttaaatgtaaatgggctaaatgctccaattaaaagacagagactggcaaattgcataaaaagtcaagacccatcagtgtgctctattcaggaaacccatctaacttgcagagacacacataggctcaaaataaaaggatggaggaagatctaccaagcaaatggaaaacaaaaaaggcaggggttgccatcctagtctctgataaaacagactttaaaccaacaaagatcaaaagagacaaagaaggccattacataatggtaaagggatcaattcaacaagaaaagctagctctcctaaatatatatgtacccaatacaggagcacgcagattcttgaagcaagtccttagacacctacaaagagactcagacacccacacaataataatgggagactttaacaccccactgtcaacattagacagatcaacgagacagaaagttaacaaggatacccaggaattgaactcagctctgcaccaagcggacctaatagacatctacagaactctccaccccaaatcaacaaaatatacattcttttcagcaccacaccacacctactccaaaactgaccacatagttggaagtaaagcactcctcagcaaatgtaaaggaacagaaattacaacaaactgtctctcagaccacagtgcaatcaaactagaactcaagataaagaaactcattcaacactgctcaactatatggaaactgaacaacctgctcctgaatgactactgagtaaataatgaaatgaaggcagaaataaagatgttctttgaaaccaacgagaacaaagacacaacataccagaatctctgggacacattcaaagcagtgtgtagaggaaaatttatagcactaaatgcccacaagagaaagcaggaaagatctaaaattgacaccctaacatcacaattaaaagaactagaaaagcaagaacaaacacattcaaaagctagcagaaggcaagaaataactaagatcggagcagaactgaaggaaatagagacgcaaaaaacccttaaaaaagtcaatgaatccaggagctgactttttggacagatcaacaaaactgataaaccactagcaagacaaataaagaagaaaagagagaagaatcaaatagacataataaaaaatgataaaggtaatatcaccaccgatcccacagaaacacaaactaccatcagagaatactataaacacctctatgcaaataaactagaatatctagaaaaaatggataaattcctcgacacatacatcctcccaagactaaaccaggaagaagttgaatctctgaatagaccaataacagggtctgaaattgaggcaataatcaatagcttaccaaccaaaaaaagtcgaggaccagatggattcacagtccaattctgccagaggtacaaaaaggagctgctaccaatccttattcaattattccaatcaaaagaaaaagatgggaatcctccctaacttattttatggggccagcatcaccctgaaagcaaagcctgacagagacacaacaaaaaaagagaattttagaccaatatcccttatgaacatcgatgcaaaaatcctcaataaaatactggcaaatggaatccagcaatacatcaaaaagtttatccacaatgatcaagtgggtttcatccctgggatgcaaggctgcttcaacatacgaaaatcaataaatgtaatctagcatataaacagaaccaacgacaaaaaccacatgattatctcaaaagatgcagaaaaggcctttgacaaaattcaacaacccttcatgctaaaaactctcaaaaaattaggtgttgatgggacgtatctcaaaataataagagctatctatgacaaacccacagccaatatcatactgaatgggaaaaactggaagcattccctttgaaaacaggcacaagaccaggatgccctctctcaccactcctattcaatatagtgttggaagttccggccagggcaattaggcacgagaaagaaataaagagtattcaattaggaaaagaggaagtcaaattgtccctgttggcagatgacatgattgtatatctagaaaaccccattgtctcagcccaaaatctccttaagctgataagcaacttcagcaaagtctcaggatacaaaatcaatgtgcaaaaatcacaactattctcatacgccaataacagacaaacagagagccaaatcatgagtgaactcccattcacaattgcttcaaagagaacaaaatacctagcaatccaacttacaagggatgtgaaggacctcttcaaggagaactacaaaccactgctcaaggaaataaaaggatacaaacaaatggaagaacattccatgctcataggtaggaagaatcaatattgtgaaaatggccataccgcccaaggtaacttatagattcaatgccatccccttcaagttaccaatgactttcttcacagaattagaaaaaactactttaaagttcatatggaaccaaaaaagagcccaaatcaccaagtcaatcctaagccaaaagaacaaagctggaggcatcacgctacctgacttcatactacactacaaggctacagtaaccaaaacagcatggtactggtaccaaaacagagatagagaccaatggaacagaacagagccctcagaaataatgctgcatatctacaactatctgatctttgacaaacctgacaaaaacaagcaatggggaaagcattccctatttaataaatggtgctgggaaaactggctagccatatgtagaaagctgaaactggatcccttccttacaccttacacaaaaattaattcaagatggattaaagacttaaatgttagacctaatactataaaaaccctagaagaaaacctaaacaataccattcaggacacaggcatgggtaaggacttcatgtctaaaatgccaaaagcaatggcaacaaaagccaaaactgacaaatggtatctaattaaactaaagagcttctgcacagcaaaagaaactaccatcagagtgaacaggcaacctacagaatgggagaaaattattgcaacctcctcatctgacaaagggctaatatccagaatctacaatgaactccaacaaattttcaagaaaaaaacaaacaaccccatcaaaaagtgggcaaaggatatgaacagacacttctcaaaagaagacatttatgcagccaaaagacacatgaaaaaatgctcatcatcaccggccatcagagaaatgcaaatcaaaaccacaatgagataccatctcacaccagttagaatggcgatcattaacaagtcaggaaaaaacaggtgctggagaggatatggagaaataggaacacttttacactgttggtgggactgtaaactagttcaaccattgtgaagtcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacgtggaaccaacctaaatgtccaacaacgatagactggattaagaaaatgtggcacatatacaccatggaatactatgcagccataaaaaatgatgagttcatgtgctttgtagggacatggatgaagctggaaaccatcattctcagcaaactatctcaaggacaaaaaactaaataccgcatgttctccctcataggtgggaattgaacaatgagaacacacggacacaggaaggggaacatcacacaccggggactgttgtggggtagggggagtggggagggatagcattaggagatatacctaatgttaaatgatgagttaatgggtgtagcacaccagcatggcacatgtatacatatgcaacaaacctgtaggttgtgcacatgtaccctaaaacttaaagtataataataaaataaaataaaagaaatacaattataggaattagtctatataaaaaagagaaaaacccttcaaaaaatcaatgaatccaggagctggttttttgaaaagatcaacaaaattgataaactgctatcaagaaaaataaagaagaaaagagagaagaatcaaatagacacaataaaaaatgataaaagggatatcaccacccatcccacagaaatacaaactaccatcagagaatactataaacacctctatgcaaataaactagaaaatctagaagaaatggataaattcttcgacacatacatcctgccaagactaaaccaggaagaagttgaatctctgaatagaccaataacagggtctgaaattgaggcaataatcagtagcttaccaaccaaaaaaagtccaggaccagatggattcacagccgaattctaccagaggtacaaggaggagctggtaccattccttctgaaactattccaatcaatagaaaaagaaggaatcctccctcgttttatgaggccaacatcatcctcataccaaagcctggcagaaaaagaacaaaaaaagagaactttagaccaatatccctgatgaacatcgatgcaaaaatcctcaataaaatactggcaaaccaaatccagcaatacatcaaaaagcttatccacaatgatcaagtgggcttcatccctgggatgcatggcttgttcaacaaatgaaaatcgataaatgtaatccagcatataaacagaaccaaagacaaaaaccacatgattatctcaatagatgcagaaaaggcctttgacaaaattcaacaacctttcatgctaaaaactctcaataaataaggtattgatgggacgtatctcaaaataataagagctatctatgacaaacccacagccaatatcatactgaataggcaaaaactggaagcattccctttgcaaactggcacaagagagggatgccctctctcaccagtcctattcaacatagtgttggaagttctggccagggcaatcaggcagctggaggaaataaagagtattcaattaggaaaagaggaagtcaaattgtccctgttggcagatgacgtgattgtatatggagaaaaccccatcgtctcagccccaaatctccttaagctgatgggcaacttcagcaaagtctcaggatacaaaatcaatgtgcaaaaatcacaagcattctcatatgccaataacagacaaacagagagccaaatcatgagtgaactcccattcacaattgcttcaaagagaataaaatacctaggaatccaacttacaagggatgtgaaggacctcttcagggagaactacaaaccactgctcaaggaaataaaagaggatacaaacaaatggaagaacattccatgctcataggtaggaagaatcaatattgtgaaaatggccatactgcccaaggtaatttatagattcaatgccatccccttcaagttaccaatgactttcttcacagaattagaaaaaactactttaaagttcatatggaaccaaaaaagagcccgaatcaccaagtcaatcctaagccaaaagaacaaagctggaggcatcaccctacctgacttcaaactgtactacaaggctacagtaaccaaaacagagatagagaccaatggaacagaacagagccctcagaaataatgctgcatatctacaactatctgatctttgacaaacctgataaaaacaagcaatggggaaagcattccctatttaataaatggtgctgggaaaactggctagccatatgtagaaagctgaaactggatcccttccttacaccttatacaaaaattaattcaagatggattaaagacttaaatgttagaactaaaaccataaaaaccctagaagaaaacctaagcaataccattcaggacataggcatgggcaaggacttcatgtctaaaacaccaaaagcaatggcaacaaaagccaaaattgacaaatgggatctaaataaactaaagagcttctgcacagcacaagaaactaccatcagagtcaacactcaacctacagaatgggagaaaatttttgcaatctactcatctgacaaagggctaataaccagaatctacaatgaactctaacaaatttacaagaaaaaaacaaccccttcaataagtgggtgaaggatatgaacagacacttctcaaaagaagacatttatgcagccaaaaaacatatgaaaaaatgctcattatcaccggccatcagagaaatgcaaatcaaaaccacaatgagataccatctcacaccagttagaatggcgatcattaacaagtcaggaaaaaacaggtgctggagaggatgtggagaaataggaacactttcacactcttggtgggactgtaaactagttcaaccattgtggaagtcagtgtggccattcctcagggatctagaactggaaataccatttgacccagccatcccattactgggtatatacccaaaggattataaatcatgctgctataaagacacatgcacacgtatgtttatagcggcactattcacaatagcaaagacttggaaccaacccaaatgtccaacaatgatagactggattaagaaattgtagcacatatacgccatggaatgctatgcagccataaagaagtatgagttcatgtcctttgtagggacatggatgaagctggaaaccatgattctcagcaaactatctcaaggacaaaaaaccaaacgcctcatgttctcactcataggtgggagttgaacagtgagaacacatggacacaggaaggggaacatcacacactggggcctgttgtgggaagtggggagggatagcattaggaaatttatctaatgttaaatggtgagttaatgggtgcagcagaccaacatggcacatgtatacacatgtaacaaacctgcacgttgtgcacatttaccttaaaatttaaagtataataataataaaatatatatatatatacacaaatggggatattacattacaacttcagagtgtgtgataagagaaagaaccaatgatttggtggagtggaggcaaaaaattgttgcatgtataagattttttgttttataaaaagttctggtctgggcgtggtggctcatgcctgtaatcacagcactttgggaggccgaggcaggtggatcacctgaggtgaggagttcaagaccagcctggtcaacttggtgaaaccccatgtctactataaatacaaataataatactaataataactgaacatgacagctcatgcttgtagtcctagcttcttgggaggctgaggcaggagaatcacttgaacccaggaagtagaggttgcagtgagccaagatcatgacactgcactccagcctaggagagggagcgacatcccatctctagaaaaaaaaaaaaagttctgacaaaaatagggcaaaatgtaggaaaataaagatctactatctgctatacttttctctatatttaaggatttatcttgattattttaaaaatacaccacacattccataccttacacagggtgacataagtgttttctttaaacatgtaatatatgcaaaacaaagcagttgagactcgtgggtagtttttttgtttgtcgtccactgtgactttacctcccttgtaatcggtgtgcaatacgcaggaaataaaaaactgtaaatcagacccattcagggctgctaatttttgttggtgtttcaactaaacccttcttgcttcaatggccctaaataggactacatagatcctgctgcctctgaatgtgagtccttaggcatagagatttttaagtcactctgaaaaatacctggaagtctaatagaagtatggtaaaattttataaagaagggagtttatgttacccatttttgcctttctgttggtattttaaatgatgaagttttaaaatataatttttagaaagaagtacaacacaagagcagaccattcagacacaggtagaaaaggtcgtaatggagtaagctcttttctcctgctgtggctgctgccacctagcggggcatttcgtgaacaacactgactgcaccgaagctgccttccatctgcttcaaacacatctgtcaatgccaagcttatatttggtttgtgtgccgtagaaagcttaaattatacagagatctggaagtctcaaaagcaatccttttatcctaaaatggatagctcagcatctagctcacctatctctctgcgtccatgacagactgaggtcctgtgtgctttatcctaatttacactcctgaattatcttcggtgagcctcattttcctcatccttcattgtcagacagtaagtaccgaggcacatgttggtgggggttgtgtgaaagcgaaatgagcttgcttactttacagctatggggtcaggacatgctcgatgcacggcaagtagcgctactgtgttctctcttgcagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccagtaggtggcacagcgtgcttcttctttaccttgatatcaaagtcttgtcatgaacacagatctccctccatttatattcaccagcgtctccttacacagatgcaatttattgagcctaatttgaagttaggaaaatgcatgttgcagagaagagttctcttcccccattgctgggttcatggctgaggccacgataacagaagccagcttaagagaaatgcataaccaaactcatttgatgtgcattttgcatgccactggaaccttcagaaatgaagacccaaagaaagagagaaaattgtgtgttttaatgtatagtcgtgcagaagtatgattagaggacgaaaagatagaatttagtggtgataaacggggaggaacttaagtctcctttgctcagcttcttccctgtgtgtctatgtcttcattcctttcctctgcatcctgggagtgtccttctggaatgaaggtttcatgacctgcttccaaggaaggccagagaattattctatgccctgcttcagggcagaaggggcaagtagaggctggagtggctttcctgcttctgcagtttcctcaaaactgcatattttggagtggttctgaacactgtcagtatcaaaggaaaattttgttttagggaattcttttcattataagatcaggaccagcaatggacctacttagttacataaaaaaaaaaacgtacgactttaaaggtttcaattagtcagtaaatttctagacttggatgcaagacaggtgtgggtctctacataaatgtagagcctatcttcagggctcccctaacccagccccgattccaggttccctacatgccccagtctgacactttctttatgtaatgaagtctctctgcaaacaacctgctaatcaaacacgctttgattctctgcttgcaacttcccggttcaggacggtccgtgaattttttttccaccttagggataaagtttcaagaagctaatatgacagaggaacctctgctgaattactagtgtgaaaccacatctgcacacgtgaactataatctcctaaagatagttgccatttttgctgtctagcccatttttgatgaaaggtttccgaaggaggaaggagtggagatattttgtggcagttcagccttttagtgcccttcggatggcaccgtggagagatgccatattattgggcagcacacaaggtcagccatcatcataaaacaagtggaatttgcacacaaacacattcagactcaatttatctcttggcagctcactgacaagtcatatttaggatttacataagaaaattgagttaggtcagtttaatgctttaaaaggttgctaatataattgaggttatagtctgcacaatttcttacctctggttatagtctgcacaatttcttacctctggtttcactgtgctctgaacagtgatttgcaaacacgtgcctgtggaatagtacttgtacatggtaaaattttcactggtccttcacaaaaaatatgaaagtaagagtgttccaactatcctgccttgggggaaaaaaagtcctttactccaaaattatatcactcttgttttttgttgtgatataaaattttcttaatcttttgaaatggtggcaagagcagatggtagaattgtgattcattggccttatttagcaaaacaaaaaagttgagaaagttatgagattatgttcattttcctcttctttccattctgtattctccaggcatttttttcaacaggttttatttttttagagtagttttgcactggcagtaagattgagtagaaggcacagagttcccacgtgctctctgtccacagcacacagcctcctccctgtcaacatccccacagagtggtccatttgttgcaatcaatgaacctacactgacccatcattatcagccgatatccacagttttctccgggttcacttttggtgttatgcattccatgggtatattattccatcttcatattgctgtaaagaactatctgagactgggtaatttatcaagaaaagaggtttaattgagtcacaactcagcaggctgtacagaaggcatggctgggagggcctcaggaaacttacagtcatggcagaaggtaaaggggaagcagtcacatcttccacgaccggggaaggggaaagacagagtgaagcggaaggtgctacgtgcttttaaacaatcagatctcctgagaactctatcatgaagacagcactgggggatggtactaaaccattagaaactacccccatgatccaatcaacccctccaggcactacctccaacagtggggattacaattcaacatgggtggggacgcagatccaaaccatatcaatgagtttggaaaaatgcatctgtagtaataacatcaccaacagtcatttccctgccctaacaattccctgtgttctgcctgttcatcccttccttcctcctaattcctagcaatcactcttttcactgtctccatagttttgtcttttcctgaaagtcacagagttagaatcacgcagtgtgtggcctttcatgttgtcttctttcacttagtaagacactttcaagctccaggtcttttcatggctgtacggatcatttctttttagcagcgaataatattctattgacttgttgtaccacagtttatttacccgtttttttccttgagatggagtcttgctttgtcgcccaggctggagtgcagtggcatgatcttggctcactggagcctctgcctcctgggttccaggaattctcctgcctcagcctcccgagtagctgggattacaagcacgcaccaacacacctggctatttttttgtatttttagcctagacagggtttcattatcctgtccaggctagtgtcaaactccttacctcaggtgatccacctgcctcagcctcccaaagtgctgggattacaggcgtgagccacctcgcccagcctgtttacccattttcttattgaaggacatacgggttgcttcaaaattttggcaattatgcctaaagctgcctctaaacatctgtgtgcaggtttttgtgtggacgtaagttttcagttcacctgactagatacctaagaagagggttcatggattatgtggaaagaatgtacttcattttactcctggccttttaaaatcttcctgttttaacaatcactgttgaaacctggccatcacttcttttttttctatatattcatgattctctcttcagagaacatctttctaacttgggtagaaaaaaagaagaagaccctttattataattatttgaggatcatggaaatgtttcttctcatataattaattattagtgtttagtaagaaataagcatgaagacaccatgaaagtttctacagaaatgacaattactattttttactcagttttccatgtgtactagtttgaatcatatgaaattgtcatttttatacgtaaaaaatgattgaatgttgacaatttcacatggtttcacgtaacacttggataggatccatccctccaaccctatcactagttaataaatccaaattctggtataaattttcagaaatactcatttaggggctagaatataacattgactctgaggcatttaaatgaaggattttctgcaagattgtctttagaagtttattgaaaggaaaaacaagatataaaaacttagagtggtacaacatttaaaaagcatagtctagactacaactctggaaatgtgagtttctatcttgacctctaatgctttgagactgaccttttgtctctgttatttttactttatttatgaaatgaggatagagtatcaatttctaaggacatttctgtcttccataattccacgctggatgtcatttattttccctttggccccaaatctactactttctcttcctttaactactctgtggctctcgaggcaaacctgtattgggttattccaataagaagccccagcatgggtgaagagatggggcaggagggcatgtcagggcacagaggcctagtacctctctcttcaggtaccccgggggccgatgtgccccaagatcaacacggacggctttgctcaagctgctgcattgaccatctctttccggatctctgtactaattccaagtaaccttcctgatacggttaggttctacgtccccacccaaatctcaccttgaattgtaatgctcataatccatatgtgtcaagggtgggaccaggtggaggtggttggatcatgagggcagtttcccccatgctgttctcatgacaataagtaagtctcatgagatctgttggttttataagggtctggcatttctcctgcttgcacttctcctttctaacaccctctaaagaaggtgctttgcttccccttcaccttcctccatgattgtaagtttcctgaggcctccccagccatgctgaactgtgagttaattaaacctctttcctttataaatcacccagtctcaggtatgtttttattagctgcatgagagcagactaatataatcccttcttcctagaatttccaaacccaaccttaggcaagaaactctcaaattatcccactgggattgtcatacgtaccatgtggcattttaaaaaatacagttctgtaaaggaccttggcaagcatatgaaatgcctgtgagtgtactacaatcagggctgtaaaataaaagtcattttcctaagacaaattatatccagttctagctcccatgcattcgagttgacaagaagtccaataccagtctatttttaaaatctgctgccaattttggatggccagggagttgctggatgattcagtgtggtgagtccagagagggacatggtcctgcctctccactagtcattatattccctcgtgctctcatttgggggccaacggtctgggcggccacagtaattcatgtcatgtgtttctctctaaggatctcaggctggaacacgaagacgctggtctgaccaccccaaagccagtcattcagctactctccacaaaatgtagcttgccacttctgggaaccagtgagaatcgggcaccagtctccatctccctgagaacctgataaacatttgactcctacacctggaataaatcatgtcctggttttctagttttagaaaagaaggttcctataacccctcagtcgtaattaagaaactgacccagttaccctgcttcactgcaggaagaaactgggctgttatgtccctctcactccacccacattcgtcccctcactggcgaatccagccatgaaactaaatcaagctggtgtctttccaaaccaaaggtgggaaactcttcacaaagtgcaaaacagcctgtccatcacacccaagaagccatcactactcttttgtaggtgggaggatgggtgggaagatggaaatctctcatttttttgtctttatgaacctgggaccaaaaaaaaaacgaggaactttacctataaattagattgtgttgtgattcataaaccatgctaattttataatttaaaacattggaattagttatgattttaaaaatttttaaatagaactcaaaaagaaatgttttcctcatatgattgatgttttaagtgtggccattgtttccaagcaaaaatgacatttattcaattgtattaaatgagatttcttagtaggctatttttacttgattctatgtcagtaacatgtgaaataagcattagaggtgtgattaaattattggagagaaaatagttatgtgaatatttgttttcttggacacatttgaattactatatttttcccaagcacactttgaagtacattttaaaaaataatttaacatcagggttgcactacctctctatcttgtaattccatgttacattggagctttttaaacacttatttgactctctcttctggaaactctttcttcagttgtttttcatcttattattctctcttgttcctccttattccaagggtcactctatcattggctctttggctgattcatatattttttcccttgaaactctaaagatcagatgccaggagggcttgtccttgggtctccctttcttctctatccatatattttttaagaagcaacaaacattaagatacccacgaaggtttctgcagaaatgacgcttgcttacttttcttttactcagcttttcatgtgtaccaatttgaactgtataaaattgtcacttttgtagggaagaaatgatggaatgttggcaattccatgtggtttaatgtaacccttggacataattcatccccccaatcccattactagttaataaatgtccaattctggtactcctaaggaaacaccagccagcctcccaggcttctcccctgagtgtccacctgccttcttgatgtctctgctttgctgcagagatgcagagaggcaactcaacacctgaaactcaaccacagtccttgttcatgcttttcccaatcctgggccccttgacatcttcccggttttggtaaagtcaactccatcctgccagtggctcaggctgtcaggatgaaacttttggagccatttttagacctctgtagatctcacaccacacagagaatccaacaatgcattcagtggagtccctattcaaaatagatccaaaatccaattctcccaacctgtgccctgccgccttggtctacgccgctgggggtctgagctgccctgccttgctcacgggcttccttcttcatgcacctgcgtactttctggcccacctgcgcacaggcacccaggtgaaccttttccgcagcaacgtgggcaacgcctcacttctgcttagaactctcccctatcttctcatctcagccagggtgacttctcattctccccactgccaaaaataaggccacaaaaccctctgaaaacttcccctaagcaattttcaacatcatcctcaatcaccatcctccactctggcaaagcctacagaaacctctactcagatgctagcctctctcagcttggatgtgtgttcctgttacacactggactgaccttccccgccttgttgcacaagaaattccagtgtgcctatctcacattcaaaggtttctttagcgaagacaatcacattgtcacttccagtccccaaacacaatgtttatacttctataatagtgcttagcccattgtgggttaccattttattaatacagtggattaagttacttgagggcagatggtctttgttttcctagaacatgacatataatcaatatccaacaagtgtctgctaattagatatgcgtgaaaattttccacgtgcataaatgttgaaaatattagtatgactttgcataatgaatacctcttcatctactgtaaacaatatgctttgtaattgagctgagcttaattcaaaattttcatagtaaagcctttaataaatatgtaactgctattttaataatgatacggtttggctgtgtccccacccaaaacttatcttgaattgtagctcccacaattcccacgtatcatgggagggacccagtgggaggtaatcgaatcatgggagcaggtctttcttctgctgttctcatgatagtgaataagactcatgagatctcatggttttataaatgggagtttccctgcacaagctctctcttctctgccaccatgtaagatgtgacttgcagtcggagaagccaagatgaacgaataggaacagctccggtctacagctcccagcgtgaacgacacagaagatgggtgatttctgcatttccatctgagctttgaagagagcagtggttctcccagcatgcagctggagatctgacaacaggaagactgcctcctcaagtgggtccctgacccccaagaagcctaactgagaggcacctcccagcaggggtagactgacacctcacacggccgagtactccaacagacctgcatctgaaggtcctgactgttagaaggaaaactaacaaacagaaatgacatccacaccaaaaacccatctgtacatcaacagcatcaaagaccaaaagtagataaaaccacaaagatggggaaaaaacagagcagaaaaactggaaactctaaaaagcagagtgcctctcctcctccaaaggaacacagttcctcaccagcaacggaacaaagctgaacagagaaagagtttgacaagctgagagaagaaggcttcagacaatcaaattactctgagctacaggaggacattcaaaccaaaggcaaagaagttgaaaactatgaaaaaagtttagaagaatgtataactagaataaccaatacagagaagtgcttaaaggagctgatggagctgaaaaccaaagctccagaactacgtgaagaatgcagaagcctcaggagccgatgcgatcaactggaagaaatggtatcagtgatggaagatgaaatgaatgaaatgaagcgagaagggaagtttagagaaaaaagaataaaaagaaacgagcaaagcctccaagaaatatgggactatgtgaaaagactgaatctacgtctgattgtcgtacctgaaagagacagggacaatggaaccaagtaggaaaacactctgcaggatattatccaggagaacttccccaatctagcaaggcaggtcaacattcacattcaggaaatacagagaatgccacaaagatactcctcgagaagagcaacaccaagacacataattgtcagattcaccaaaggtgaaatgaaggaaaaaatgttaagggcagccagagagaaaggttgggttaccctcaaagggaagcccatcagactaacagcagatctcttgacagaaactctacaagccagaagagagcggtggccaatattcaacattcttaaagaaaagaattttcaacccagaatttcatatccagccaaactaagcttcataagtgaaggagaaataaaatactttacagacaagcaaatgctgagagattttgtcactaccaggccttcactaacagagctcctgaaggaagcgctaaacatggaaaggaacaaaaggtaccaggcacggcaaaatcatgccaaattgtaaagaccatcaaggctaggaagaaactgcatcaactaacgagcaaaataaccagctaacatcataatgacaggatcaaattcacacataacaatattaactttaaatgtaaatggactaaatgcaccaattaaaagacacagactggcaaactggacacagagtcaagacccatcagtgtgcactattcaggaaacacatctcacgggtacagacacacataggctcaaaatgaaaggatggaggaagatctaccaagcaaatggaaaacaaaaaaaggcaggggttgcaatcctagtctctcataaaacagactttaaaccaacaaagatcaaaagagacaaagaaggccattacataatggtaaagggatcaattcaacaagaagggctaactatcctaaatatatatgcacccaatacaggagcacccagattcataaagcaagtcctgagtgacctacaaagagacttagactcccacacattaataatgggagactttaacaccccactgtcaactttagacagatcaacaagacagaaagtcaacaagcatacccaggaacttaactcagctctgcaccaagcggacctaatagacatctacagaactctccaccccaaatcaacagaatatacatttttttcagcaccacaccacacctactccaaaattgaccacatagttggaagtaaagcactcctcagcaaatataaaagaacagaaattgtaacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagagtctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaactgaaggaaatagagacacaaaaaacccttcaaaaaattaacgaatccaggagctggttttttgaaaggatccacaaaattggtagaccactagcaagactaagaaaaaaacagagaggaatcaaatagatacaataaaaatgataaaggggatatcaccaccaatcccacagaaatacgaactgccatcagagaatactacaaacacctctatgcaaataaactagaaaatctagaagaaatggataaattcctggacacatacactctcccaagactaaaccaggaagaagttgaatctctgaatagaccaaaaacaggagctgaaattgtggcaataatcaatagcttaccaacgaaaaagagtgcaggaccagatggactcacaaccgaattctaccagaggtacaaggaggaatttgtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgtaaaaatcctcaataaaatactggcaaaccgaatccagcagcacatcaaaaagcttatccaccatgatcaagtgggcttcatccctgggatgcaaggctagttcaatatacgcaaatctataaatgtaatccagcatataaacagaaccaaagacaaaaaccacatgattatctcaatagacgcagaaaaggcctttgacaaaattcaacaacctttcatactaaaaactctcaataaataaggtattgatgggacgtatctcaaaataataagagctatctataacaaacccacagccaatatcataccgaatgggcaaaaactagaagcattccctttgaagactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctggaaaaccccactgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcacaattgcttcgaagagaataaaatacctaggaatccaacttacaagggatgtgaaggacctcttcaaggagaactacaaaccactgctcaaggaaataaaagaagatacaaacaaatggaagaacattccatgctcatgggtaggaagaatcaatatcgtgaaaatggccatactgcccaaagtaatttacagattcaatgccatccccttcaagttaccaatgactttcttcccagaattggaaaaaactactttaaagttcatatggaaccaaaaaggagcccacattgccaagtcagtcctgagccaaaagaacaaagctggaggcatcagactacctgacttcaaactatgctacaaggctaccgtaaccaaaacagcatggtactggtaccaaaacagagatatagatcaatggaatagaacagagccctcagaaataacgccgcatatctacaactatctgatctttgacaaacctgagtaaaacaagcaatggggaaagcattccctatttaataaatggtgctgggaaaactggctaaccatatgcagaaagctgaaactggatcccttccttacaccttatacaaaaatcaattcaagatggattaaagacttaaacattagacctaaaaccataaaaaccctagaagaaaacctaggcattaccattcaggacataggcatgggcaaggactgcatgtctcaaacacaaaaagcaaaggcaacaaaagccaaaattgacaaatgggatctaattaaactgaagagcttctgcacagcaaaagaaactaccatcagagtgaacaggcaacctacaaaatgggagaaaattttcacaacctactcatctgacaaagggctaatatccacaatctataatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggctatcagagaaatgcaaattgaaaaccacaatgagataccatctcacaccagttggaatggcaatcattaaaaagtgaggaaacaacaggtgctggagaggatgtggagaaataggaacacttttacactgttgctgggactataaactagttcaaccattgtggaagtcagtgtggacattcgtcagggatctagaactagaaataccatttgacccagccatcccattactgggtatatacccaaaggaatataaatcatgctgctataaagacacatgtacacgtatgtttattgtggcattattcacaatagcaaagacttggaaccaacccaaatgtccaacaatgatagactggattaagaaaatgtggcacatatacaccatggaatactatgcagccttaaaaaatgatgagttcatgtgctttgtagggacatggaagaaattggaaatcatcattctcagtaaactatcgcaagaacaaaaaaccaaacaccgcatattctcactcaaaggtgggaactgaacaatgagaacacgtgaacacaggaaggggaacatcacactctggggactgttgtggggtggggggaggggggaaggacagcattgggagatatacctattgctagatgacaagttagtgggtgcagcgcaccagcatggcacatgtatacatatgtaactaacctgtacgttgtgcacatgtaccctaaaacttacagtataataataataaataaaaaattaaaaaaaaaaagaaaaaaagatgtgacttgctcctgcttaccttctgccataattgtgaggcctccccagccatgtgaaactgtgagtcaattaaaactcttttctttataaattacccagtcttgggtatgtctttatcagcagcatgaaaacagactaatacaaatagcaaagttccttcccctctggattattttacatccactgttgataaatagtttaaagtaaatggttttgtatgtttattatcagaagtacttgatactgtagacttgctttgatgagtaaagaacacattatacctatataataaaagggctgcatctgtgtcgacctgttaagtgttataattcttgataaagttcttttactcttgatcacttaaaattttgataccagttggaaatcaggcagaatagttttatgaagttcaatggtcattttttaagtaaccatagtttttaatctatcacctggtaaattttcttcattaaaactgatcattttttttcactgctttaaaataatcttgaggcagcaacaactgtctagtaagaggatggaaaggccaggtgcagtggctcatgcctgtaatcccaggactttgggaggccaaggcagacggatcacaaggtcaggagttcaaggccagcctggccaacatggtgataccccatctctactaaaaataaaaagataaaaaaattagcaaggcatggtggcatgtgcctgtaatcccagctacttgggagtctgaggtaggagaatcgcttgaacccgggaggcagaggttgcagtgggccaagacagtgccactgtacttcgccctgggcaacagagcaagactccatctcaaaaaaaaaaaaaaaaaaaaagaagaggttagagaaagtccttgctcatcttccatgcttcatgtctacgtgcatgttgatggccatcaatggagtagggttgtgacctaaactttgctttatgtgcgtttaccttcactttatggaagactaaattttctccactagaaaaaggagctttagaggctcatgagatatccaaaccccattaaaggtccactgtcctgccagctctgcacagcatgtaaaacagaaggacatgaactgactactgcaattatgttaattgtaatcagcctgacacttttcattaaagcttaattaccatttaatcatgcataaaactcacgaaaatggagttcagcacacaaagctgacctttactctgggggttaaataaacgctcagtgtggcactgtcagctcccccagtcccagggaaaaatggctctgcaaccatgtttcattctcaggttttgcgagattgatttctccgtaaatagtggtagtaatgtaacagctacatgacacctctccctactttattgaaagataacttaataggtgcattttcattttaaaacatcatttgttgtttattacaggagaggcctttggtgctgcccatggcagaacaggctgggactgttttatgggagaaaaccagccgtaagcctgtgtggttgatggtccaagtttctctgcctatgaagggcagcacaagacaagcgtagctggagccatcgctcccctctgctctcggcatcttcctcatgggactggcagagaactggccgcacatttttatgattgaccacttaggatcatagattgtgaacagcataggcccaaagacagctgcattcagctttccgtcccgtggacacctggtccatgacacagatacgaagaatgcgtgttgaattgattgaaagtaagatgctggtttagctgaagttctaagtcttgtatactgggggatgacaggattttagctctgattcattttctctaacattagcgagattgattacaaatcgaaggagagaatcaagacatgtaaaatggcacttctcctattcttgaggatggaggtttaatacttattactcaatagaatatcagcttctttctataaaaaatactagctggaatatcacttatggccacctttctgctaatatgaatccagctcatgttggaagggtgtttgtccatacctcaggcaacagtcatttcaggccccactgtcccccaggaccctgggcataaaattttctgataagtctcaaactcccaatcaacacaggagtaggtaggcagaggtagacaacagtaccccatggagaaagaaatggtccacatttaattcactggattatcacaatgtctttaaaaacatgttattcggaaataaattgtttcagtaatgagaacacaaaaaatgccagtcaccaagacaaacattaaaatgaaccatctgggcctggcacggtggctcacgcctgtaatcccagcactttaggaggccgaggtgggcggatgaggtcaggaaattgagaccatcctggctaacacggtgaaaccctgtctctactaaaaatacaaaaaaatcagctgggcgtggtggcgggcacctgtagtcccagttactcgggaggttgaggcaggagaatggtgtgaacctcggaggcggagcttgcagtgagctgagatcacgctccagcctgggtgacagagcaaaactccgtctcaaaaaaaaaaaaaaaaaaaaaaaaataggaaatgaaccatctgaccacaccctgatgggagaaagtcgccctggcctcattgtgtgcatgatggcactagtgtaatcattctgaagcaacaaacttaccattcgatattcactcattcattcattcattcattcagatatcagttcatacattcacctacaaatatcccgtctcttcctattgtgccctgagtaccccatgggcattggagatcaatgctgtggaaggcaaagattggcccgtccctcataaaactaccaggaagggcagacagaggcaactgagcccacacagggcaatgaccctgtcttcatggaatcctgttcccctctggcataatcctcatttctgaggctctgccctctgctgccctttgatctcccaccccagtgagttaggactctatgcaggtccctatggccctgccagggtcctgcacatcccgtcaatggttggcccagctgggtgacatcagccccggcctctgcaccccttggtctccccgctccactcccatcagctgctgtgggaggcatgtagtgtgccccacccaccgggtaacccaaaacatcagatgtcagcccgttactctatactgctgcttctctttccatccctgcttcctcactgtatgttggctctttgcttttgccgggacacatttctttcctatcagcagcgatgccatcctcaaagtctcttaccagtgtgttacattcccttgtgctggaagctccctggcccagcatctgcctggattctctcctctggactccggagagctcctgaggaaacctcacgcctggcagcttgtttaccagtgtacatgcacggccaccaaccacgcaactgctcaactgccatcatctattgttgcagcgaagccttgctccaacgcacctttgtatttcaaatcttccaatgcatcaacacccctttcgtacgcgatagatgatcttgtgggatatgacccagtgggatatcacgccttgtgagacgcaaagctatcagggggtttcccttcacttccttccaacggtcatgcaagctagcagtgagccactgtttctcactcctgttacctgggaattctgacccctctcccaggcagtggtggtcctccagcagacattcccgctggctgccgcgggacgacctctgggtggaagcctctttctctcctgattttcacccttccctctctctggcttcttgcttcttgtatgtaaatatgctcaagtctctgacatttaaaaataatacctaaaactaccatcgttcacatatgagtgtcagcttgtttgtcttctccttttagagcaaaattttataccttagtctatgttggctgtctgcatttcttgacctctaagttattccacaacccagctggttttgtgtttctacactcatcactctgtgattactgctcttgtcactgtcataaataccatgcacctcaaccaattcatctgagggtggtcctttttttttttttttgattttttttaagacagtgtctcactctttcgcccaggctggagtgcagtggtataatctcagctcactgcaaactctgcctcctgggttcaagcggttctcctgccttagcctcctgagtagctgggattacagatgcttgccaccatgcctggcttttttttttttttttttttttttgagagggagtctcactctgccaccaggctggaatgcaatggcatgatctcggctcactgcaacctctgcctcctgggttcaagtgattctcctgcctcagcctcccaagtagctgggattacaggtgcctaccaccatgcccggctaatttttgtatttttcatagaaatggggttttgccatgttagccaggctggtctcaatctcctagtctcaggtgatccacccgcctcagcctcccacagtgctgggattacaggtgtgagccactgtgcccggccgggtggttctcttaaacggccccttgcagaactgtggtgctactgcctttccgccttacaaccctctttcgtctaggttttcatgatcatcccgggagccccctgactccctggccactattttgcctcttgtcttctgcttgcccttgagaggcaggtgtcctggagggttggtctcaggacatcaggtctgctttctgcacatactctctctttgcaaattaatttttcccccaggcatggacatggattcataaggtaataacttcaaagctctctatttccagctcatgtctacctcatgaacctgtaagatgccaattagataagttcatttgaacatcttgcagacatctaaaaataacgcatccaaaactggacccctttccctggccaagtgctgaatttcctgcttgtggcctccaaggagatggagaagctgatctcagtccgcttttctcttccccacctgagctactgcatcacccaggtctccaccaagcaaaaccctagtctgaaggactgtgtggagggtgcaactgcatcaaagtcatgctgaagaaaggccatgctggcagaaggaaaggtaaaagctagggccctgctttgagaaaaaaacctcttcagattctcacttatattagaataaaatcctagcacgacctcatgttggccagcactgggcttctccaccttcactcctctccttcactcttggttcctgacagattatttctttgctgtttttgagccttcaaattcccaggtaacaggagtgtgctactccctctctctaagactcactcccttctccagccccttctgttctcatgacaggttgcggttaaacaccactctgtttaggaaacgtctctgatccctgagagtaaataacgacccatttaatatgattcttacactccccccttcacaagattcatagaaattatctttatcacgcttggctgttgctgaatatcgtgcgtgcacaggtcatacatacttcgcactgatttctgcgtttaccatttcttcctcctctgcctcacatttgacacttagtagcattttgtcttcccttgttttttcattatttcttcgttatgtgtctgtgcttattttctgattcttattttttagttattggttctagtgagagtgtaaattccttaaatatttttaatatctctgctctaatagtgacaatccttaacatggtgccagctacaagagcagctattcaacagatttgtgttgaattgccttctgaagtgccctaaagatgcttttcccatataatttaaattctcacagaggtggttaaaatacagctggggtgcagaccctggtaatatacttagcagcattcatcgttattaaagaatatataagctataccgatgttagcaattctgacactgagtacaagaaaaatgtatacacacacaggccacacacacccacacacagcccacccacacatatagtatcagtatagtttttacagtaggcaaaacagaggcactgtttctggcctgggtttagcctcatctttactagctatgtacccttaatcatgtagattaaactctattagcaatcatttcctagttaattaagttaaattaggacacaatactctttttacgaccccacagttttgatgagtacttcccttagaagaaagaaacacaaaagcagttcgatttatacgttttctgcaaatataaatgattgttaatatttattctctgttctagaggcatatccactccagggaagcattacgtggtaaatgattcagtgtgcagttctcaaattagatttttccctctctttggcctcctgatcacctcactcgattcaaactgacagaaataagattctcctgacacttgtgtggcaaaaaggcacatagcgagtggaattttgacttagaaacaggaaaagatagaacacaagtaaatagcactgtatcacactaatgttataataccagatcttcacattactacgccacctgaggtttccataacataatgaaattccaaaccaggtacttattgttaataaagaactggtgaattcgcagagaatgtttcctaagaaatctaataattacttcctcacctcaagtctgccttgtgtcaatatacagatttttattgttcatacctgctagaaagctgggaatcagtttaatcatattattgaggtgaataaatgtttagaaaaggatctctgggaaataaagtttgaattttcaaatttcgtttcattgttactatgaaaaaaactgaagtctctttaaataaacaaattaaggatctttcagtttcatgaggatgcaaaaaatagaattttatgctgcattcaaagtttaaatgttagcgttaccattaggtaaaaagtgtttttaaaataactttaaacagtgtactatttttacacatcaaagaagagacatacttggttttcccacagatgtctaatcttcacatgatgaaagcaaaactattagtgtctttgtgtcagagaagtcacaattcatttattaaagaaagttagttgactttacaatgccatcttaagaacttaattgggataagtgattcaaatactattgtgaacagtattcacttatcctatttttatgttttacattttctaatttgggtaactatatgttatcaatctctcaaaaatataatttcatactaaaaatattaaaacatttatttgtaagaaatttcaaaaattacttgaatgtattaccaaaaatgaacatttactatagaccagtaatattctctttccaataactgattataaggctctttgaattcatctgagataaacaaagacccaatgtatccatatatacataggggaattagaatacaactgtaacagtggatgaagcaaggcctggcacggtggctcatgcctgtaattccagcactttggcaggtcaaggcaggcagatcacttgaggccaggagttcgagactagcctggccaacatggtgaaaccccattttatctaaaaacacaaaaattagccagatgtggtggcacacacctgtaatcccaggtactcgggaggctgaggcaggagaatcgcttgaacccaggaggcaggggttgcagtgagctgcgatcatgccactgcactccagcctggacaacaaagtgaaactctctgaaaaaaaataacagttgatgatgcaagagaaaacatataaggacaattattacacaaagtaggtgacatatgaattcaaaaatgagaatttatgggtcaaggagatttattgcctagcttaataactgtaatgtccataatacttcttgaatattacgtcttttaattaacaacaaactttttcataggattcctactgagttttctcttgcaatgaagttcacattccctcttgtacaaaataaaagtaatttacttatttctattacatacatttttgtagattgtagaattcatttacttatgtttaataggtatacattatggcatgtttttataactattaagtacttgttaaacactaagcttattaaaggacattttccactatgagacattacaatgaactctcgaggggcagattacaccaggtattccatgtttgcttgaataatgtcacttattctgtctatacctctactttaatacctgtgcttccactgactataatctttcacattttcagaggttttaacagggaatctttgtcctttgattttttctttttcttttttttttcatttggcccgaagtaatagcatttatagcgcctcttggataaacagtaattatgttaactggaaaggacactttctttggtttagtatttattattattccaagagaatggtcattatccccagcaatgggtgatgctgaaaatggatactgtcatcttcagatttaccaatatttgtcaggagtttcacaatcatgagattcatattgccttctatcacaaaggtacattcagaaatacatgacttctgtgacgcttattggcaatgttttaacctctcggaattttgaaattaactatgtgtgtgtatatatatatatatatatatatatatatatatatatatatatatattcatatgagcataattttagaaataaaatggtttgcattcactgtccataattcaaatgaatactgcaactcagacatacataacctttacttttttaattgaacttgttttactttggggtaatcatagatccacttagagtggcaacaaataaaacagagaccctgtgcacactttacccagtttcccccaagagtaacatcctgtagaactagagttcactatcacagcccacgcgttgacattgatactatcaataagtaggacatttcccccaggaataggatcccacaggctgctctttgatagccgtacccattgacctcggcccgcatgccttcgtaatccctggcagccattcatctattctgtacttccagacttttgatcatttcacaaatgtgctgtggagggaatcaggcagtgtgtcgtctctcggactggcctcttcattcagtacctttctgtgggtgctgatggggccggcttgttgcatgaatccagggcatattcctttagattcctgcagagaactccagggaatggaggcagcagttggtttaatcactcaccgccgaaggacacctgggtaatttccagattgggactcctatgagtacagctgtgatgaacattcacgcgcaggttttcttttcaaaattattttatttttctgtaagtttttggggttcaggtggtatttggttacacgagtaagttcttcagtggtgatttgtaggattttggcgcacccatcacccaagccgtatatactgcaccatatttgttatctttatcatgggaacgtaagtttctatttctctgagataaatgcccaagaatgcaattgcagaattgaatgttttgcttttaactgccaaataattttccagaatggctgtaccattttacattctcaccagcaacgcgtacgtgattctgtttttctgcctcctatgcaacatttgatattttacagacgatataaaattgtctatggtatttacatcatttagaaaacatatatagtagaaattttaaatttaagtgtgcttataaggatgcagtgatatctctgcatttatttgcttaatggctactaatttagagcatcttttcatgttttatagttctcacctgtgtttcctctacagtgaaaggttttttttggtatttgtttgttgttgttgttgttccttttcccattttctaatgggattttatttttctttactcttcagtcttgagcattctttatatttttaagacactagtctgttgtcagatacgtggctttcaagcattttctcccagtctgtagcttgtctttccatcctcttcacagggtcttttttagagcaaaagcttttctgttttgatgaagtctcatttattcattttggcttttatggattgtgcttctgttgtcaagtcgaagagccccttgcctaactcttgaggtaggtcgaggttctcattttgttttgtgtaatactcaagaaccacgtattactttggaaaatataaagaaagggattgtcaaaaatgtttctctccctaagcactggagccatcctcagcctctgctcttcgaggggggtttgttctcggtggaccctctctgtagttattgaagcactctgacattttcagaaatgaaatgaggaatgtttatccttaattaggtggaacgttcttgtatccatgccactgtctttcctctggagtctgggctgagttgatgcaccccgatggggctggaggatatactccttctatgtgttttccaaacctgttcggccactgaaacacggaggcacccgacacaaaactccagctgctggttcccattgatcctgcaacacccaaagccagggagcctcacagaggtggcgtttctattctgggcgaggatctcaccctgaagagcaactttgagaaaatgataacctagttatatgcataaagagttcaattcagggtgaggaagcagataataaagcactttttcaatttgcttaactcaaagacatgagaattaatgggaaagagcaaggtaagggaaatgccatatacatgcaaagaaaaatgccatataaatgcaaaaaaattatttcataattatagttctgtaccggggaggagcaaaccttttccctgaagagtcagagagtagctattttaggctttgcaggtcctgtggtctccaaggcaggtcctcagctctgtggctgtgtagcccaaaggcagctacagacaacgcatgtatgagtggtcagagatgtgtttgaatttcatgtgtcataaattaatattttattttgatattttttaaccatttaaaaaatgtaaaaccattcttagctttcaagctacaatactagctgatgggccagatttgatttccagtatacagtttgccaactcatgttttagaccatttaacacaaaatcaatcagtgagtgctttagtatttgcattagactcaccaatttagtaaatttcaggatggggtagaaactccagtatttcacttgtatacatattaaaatctcgaggaggaatttgtcatgtcaaatgagaaaagacacatcatgtttaacaactaatcattgtaatggagttgtaatgtcattttaaataaaataacctaccccttacagacaaagaaaagctaatatcagactgaaaatttcaattcttttgaatacttaagaatgatatgcatcctgggttctcattcattcattcattcactcattcattcaggccatcaggattactgagtgtccgtaaacctgcagcctccatgctgagagctaagcaggactgagtgaacgaagtcaagattcctgctttgcagagctcacatgctaactagaaatccatgagttttcaaagaaactcataaatgcatacgtcttccattctgtaatcaggttattaattttagaaaacgcctttcagattatttaggtgtctttgttaatacctggaatatgagtccatactaataagaatgttttcagctcaatatggccctagcccttggaataataatttgtcttgtcataaaagctgtggttaagatacctgctttatatataagtagcaggtgcccttggcttccctagagctctggagtacctttgtgcctaacctagattcatcacccagctattaagcctagtacccattagttatttttcctgatcctctcccttttctcactttccaccatccgggagaccgcagtgtctattgttcccctttatgtgtccatgtgttctcatcgtttagctcccagttataaatgaaaacatgcagtatttggttttctcttcctgcatttgtttgctaagaataatggcctccagctccatccatgttcctgtaaaggacatgatctcattcttttttaaagctgcatagtattccatggtgtatatgtaccatgttttctttatccagtctatcactgatgggcatttaggttgcttccatggctttgctgtggtgaatagtgctgcactgaacatatgcatgcatgtgtctttataatagaatgattttattcccttgggcatatacccaataatggattgctaggtccaatgatatttctgtctttaggtctttgaggaatcaccacactgtcttccataatggttgaactaatttacatttgcacaaacagtatttaagtgttcctttctctccacaacctcaccagcatcttttatatctcggtttttcagtaatagccattgtaactggtgtgagatggtatctcattttggttttaatttgcatttctctaacgatcagtgatggtgagcttttttccacgattgttggcaacatgtatgtcttcttttaaaaagtgtctgttcatgtcctttgtccatgttttaatggggttgtttttgtcgtgtaaatttgtccaagttccttatagatgctggatattagacatttttcagatgcatattttggaaaaattttctccctttctttaggttgtctgtttaccctgttcattctcatattctgtctttcatatcccacatgcagcccatccagaaaccttattggacatacctataaaatttatgagaatggggccctgtctgtctactcgacaccatctcccatggctgagtctcctccaatctcctgccgtgcccctgcaatagccttccacctggtctcacggcctctccatggtctgtcctgaacacagtggctacattaattctttaaaatataagcttcacgcccttgtaacattttcagaacccagcaatggcccctggatcactgagtcaagccccaagtcccttgcagctgcctgcaattctcccctcaccccacccaccgatcgccctcacacctcccttggaagcctcatcatccacccccttctcagctccagccccagaaatgtccatgcttctccaacaaggctctaggcccaccgtttagggtctttgatagaaacttcagttctccttctcagtagccttggccccaggtacccgcaaggctgattctgtctctatcttaaaatatgtgtcatcatctcaggggaacttccatgaccagcccacctgaaatcaccaccaactgccccccagcactctcagtgccatcgacactcctgtcttctttatcccaacgcactgtcactgtccatatccataatatttcatttattacttggttgtattttgtattgttatctcctcccttgagaatctaacctccacaaggaaagagatcctaatttgttgattgatgtgtcccaagtgagtagaactgacatgcagtaggcactcagaagttttctgtttgttttgagatggagtttcactcttatagcgcgggctggagtgcagtggcacggttttggcttgctgcgaactctgcctcccaggttgaagcgattctcctgcctcagcctcctgagtagctgggattacagatggatgcaccaccaaacccagcaaatttttgtgtttttagcggagatggggtttcaccatgttggccaggctggtctcaaactcctgacctcaagtgatccacccaccttggcctcccaaagtgctgggattacaggcatgagccactgtacctggccctcagaagtatttctgaatgaaggaataaatgaatgaatagtaatgaaaattctcttacaaatattttattttctcttctcaatttactgagttttagataatgtaaaattttgttagttaacattctatttttgcattgtgaatttttttggctaagagttgaaaaatctcctcctaacataactaccttggaaaggaaaaattaaaataagaatcctgtgactcagagtgttcttacaagaaaagatgcctttggttaaataacatacacaagatgtcccttttctgagtcaggatttaaacatgcagacatcaaaggtggactttctgggtgttgacaggcatatgggtggctgcaggatccagttctggaagtgtgggtgttcttgcaaggcacacatgttggaagtgggattcagagtcaaaagtaagaaacagccagtgttgttggttcatttgtcaggagacataaagcaaaaggggcaagattatagcttttttagtgcatgcaataaatcctaaaggagatgtcttttatatatctatagatatagtagctagatctgaagcatcaataaaaagttaggagaaggggacaatgaacttatttcgggatggctgcaacatgtactgctggggcacagtgtctgcctactgccattgttacaacagttgtggtttgtttccttcctttctttccttcctttcttctcttttttttttttttttcttgagacttagtcttgctctgtcaaacaatatcagcccactgaaacctctgcctcccaggttcaagcaattctcctgcctcagccccctgagtagttgggattacaggtgccaccaccacgcccagctaatttttatatttttagtacagaggaggtttcaccatgttggccaggctggtctggaactcctgacctcaggtgattggtctgcctcagccccccaaagtcctgggattacaggtgtgagccacctcacccggctcagtcattgtcttctataaaaatgtgtacttggatgggagccaagatggccgaataggaacagctccagtctacagctcccagcatgaacgatgcagaagatgggtgatttctgcatttccaactgaggtaccaggttcatctcactggcgagtgtcggaaagtgggtgcaggacagtgggtgcagcacaccaagtgtgagccaaagcaggatgaggcatcacatcacccgggaagcacaagaggtcagggaattccctttctagtcaaagaaagtgttgacagacagcacctggaaaatccggtcactcccaccctaatactgcactttcccaatgggcttagcaaacggcacaccaggagattatatcccgtgcatggctcagagggtcctacgcccacagagccttgctcattgctagaacagcagtctgagatcaaactgcagggctgcagcaaggctgggagaggggcgtccaccattgcacaggcttgagtaggtaaacaaagcaggtgggaagctcgaactgggtggagcccaccacagctcaaggaggcctgcctgcctctgtaggctccacctctgggggcagggcacagacaacaaaaggcagcagaaacctgtgcagactgaaatgtccctgtctgacagctttacatagagtagtggttctcccagcacacagcttgagatctgagaatggacagactgcctcctcaagtgggtccctgtcccccgagaagcctaactgggatgcatcccccagtaggggcagactgacacctcacacggctgggtacacccctgagaaaaacttccagaggaatggtcaggcagcaacattcgctgttcaccaatatccactgctctgcagcctctgctactgatacccaggcaaataggttctggagtggacctccgcaaactccaagagaccggcagctgagggtcctgactgttacaatgaaaactaacaaacaggaaggacatccacaccaaaaccccatctgtacatcaccatcatcaaagaccaaaggtagataaaaccacaaagatggggaaaaaacagagcagaaaaactgtaaactctaaaaatcagagcacctctcctcctccaaaggaaatcagctcctcaccaacaatggaacaaagctggatggagaatgactttgacaagttgagagaagaaggcttcagactagcaaacgaccccgagctaaaggaggaagtttgaacccatggcaaagaagttaaaaaccttgaaaaaaaattacatgaatggctaactagaataaccaatgcacagaagtccttaaaggacctgacggagctgaaaaccaaggctcgagaactaagtgacaaatgcacaagtctcaatagccaattcggtcaactagaagaaagggtatcagtgatggaagatcaaatgaatgaaatgaagtgagaagagaagtttagagaaaaaagaatgaaaaggaacaaagcctccaagaaatatgggactatgtgaaaagaccaaatctacgtctgattggtgtacctgaaagtgacagggagaatggaaccaagttggaaaacactctgcaggatataaaccaggagaacttccccaatctagcaaggcaggccaacattcacattcaggaaatacagagaatgccacaaatatacccctcgagaagagtaactctaagacacataattgtcagattcaccaaagttaaaatgaaggaaaaaatgttaagggcagccagagagaaaggtcgggttacccacaaagggaagcccatcagactaacagctgatctctcgacagaaactctacaagccagaagagagtgggggccaatattccacattcttaaagaaaagaactttcaacccagaatttcatatccggccaaactaagcttcctaagtgaaggagaaataaaatcctttacagacaagcaaatgctgagagattctgtcaccaccaggcctgccctacaagagctcctgaaggaagcactaaacatggaaaggaacaactagtaccagccactgcaaaaacatgcaaaattgtaaagaccatcaaggctaggaagaaacagcatcaactaatgagcaaaataaccagctaacatcataatgacaggatcaaattcacacataacaatataaaccttaaatgtaaatgggctaaatgctccaactaaaagacacagactggcaaattggataaagagtcaagaccctacagtgtgctgtattcaggaaacccatctcacctgcagagacacacataggctcaaaataaaaggatggaggaagatctaccaagcaaacagaaaacaaaaaaagattcataaagcaagtccttagagacctacaaagagacttagactcccacacaataataatggcagactttaacaacccactctcaactttagacagatcaatgagacaggaagttaaaaaggatatccaggaattgaactcagcactgctccaagtggacctaatagacatctacagaactctccaccccaaatcaacagaatatacattcttttcagcaccacaccacacctagtccaaaattgaccacatagttggaagtaaagcactcctcagcaaatgtaaaagaacagaaattataacaaactgtctctcagaccacagtgcaatcaaaccagaactcagaaataagaaactcactcaaaaccactcaactacatggaaactgaacgacctgctcctgagtgactactgggtaaataacgaaatgaaggcagaaataaagatgttctttgaaaccaacgagagcaaagacacaacataccagaatctctgggacacatacaaagcagtgtgtagagggaaatttatagcactaaatgcccacaagagaaagcaggaaagatctaaaattgacaccctagcatcacaattaaaagaactggagaaccaagagcaaacatactcaaaagctagcagaaggaaagaaataactaaaatacccttcaaaaaatcaatgaatccaggagctggttttttgaaaagatcaacaaaattgatagactgctagcaaaactaataaagaagaaaagagagaataatcaaatagacacaataaaaaatgataaaggtaatatcaccaccgatcccacagaaatacaaactaccatcagagaatactataaacacctctatgcaaataaactagaaaatctagaagaaatggataaatttctggacacatacaccctcccaagactaaacgaggaagaagttgaatctctgaagagacgaataacaggctctgaaattgaggcaataattaatagcttaccaacctaaaaaaagtccaggaccagatggattcacagccaaattctaccagaggtataaggaggaactgctaccattccttctgaaactattcaatcaatagaaaaagagggaatcctccctaactcattttatgaggccagcatcatcctgataccaaagcctggcagacacacaacaaaaaaagagaattttagaccaatatccctgatgaacatcaaagcaaaaatcctcaataaaatactggcaaagtgaatccaacaatatatcaaaaagcttatccaccatgatcaagtgagcttcatccctgggatgcaaggctggttcaacatatgcaaatcaataaatgtaatccagcatataaacagaaccaaagacaaaaaccacgtgataatcccaatagatgcagaaatggcctttgacaaaattcaacagcccttcattctaaaaactctcaataaatcaggtattgatgggacgtatttcaaaataataagagctatctatgacaaacccacagccaatatcatactgaatgggcaaaaactggaagcattccctttgcaaactgtcacaagacagggatgcgctctctcaccactactattcaacatagtgttggaagttctggccagggcaatcaggcagaaggaaataaaaggtattcaattaggaaaagaggaagtcaaattgtccctgtttgcagatgacatgattctatatctagaaaaccgcattgtctcagcccaaaatatccttaagctgataagcaacttcagcaaagtctcaggatacaaaatcaatgtgcaaaaatcacaagcattcttatacaccaacaacagacaaagaaagagccaaatcatgagtgaactgccattcacaactgcttcaaagagaataaaatacatatgaatccaactgacaagggatgtgaaggacctcttcaaggagaactacaatccactgctcaatgaaataaaaaaggagacaaacaaatggaagaacattccatgctcatgggtaggaagaatcaatattgtgaaaatgcccatgctgcccaaggtaattgatagattcaaagccatccccatcaagctaccaatgactttcttcacagaattggaaaaaactactttaaagttcatatggaaccaaaaaagagcccgcatcgccaagtcaatcctaagccaagagaacaaagctggaggcatcatgctacctgacttcaaactatactacaaggctacagtaaccaaaacagcatgatactggtaccaaaacagagatatagaccaatgcaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggattccttccttacaccttatacaaaaattaattcaagatgggttaaagacttaaatgttagacctaaaaccataaaaaccctagaagaaaacctaggcaataccattcaggacataggcacgggcaaggacttcatgtctaaaacaccaaaagcaatggcaacaaaacccaaaattgacaaacgggatctaattaaactaaagagcttctgcacagcaaaagaaactaccatcagagtgaacaggcaacctacaaaatgggagaaaattttcacaatctactcatctgacaaagggctaatatccagaatctacaatgaactcaaacaaatttacaagaaaaaaacaaataaccccatcaacaagtgggtgaggggtatgaacagacacttctcaaaagaagacatttatgcagccaacagacacatgaaaaaatgctcatcatcactggccatcagagaaatgcaaatcaaaaccacaatgagatatcgtctcacaccagttagaatggcaatcaaccattaaaaagtcaggaaacaacaggtgctggagaggatgtggagaaataggaacacttttacactgttggtgggaccataaactagttcaatgattgtggaagacagtgtggcgattcctcagggacctagaactagaaataccatttgacccagccatcccattactgggtatatacacaaaggactataaatcatgctgctataaagacccattcatacgtatgtttattgcggcactattcacaatagcaaagacttggaaccaacccaaatgcccaacaatgacagactggattaagaaaatgtggcacatatataccatggaatactatccagccataaaaaataatgagttcatgtcctttgtagggacagggatgaagctggaaaccatcattctcagcaaactatcacaaggataaaaaaccaaacaccacatgttctcactcataggtgggaattgaacaatgagtacacatggacacaggaagggaaacatcacacactggggcctgttgtggggtggggggatcagggagggatagtatttggagacatacctaatgttaaatgacgacttaatgggtgtaccacaccaacacggcacatgtatatatatgtaacaaacctgcacgttgtgcacatgtaccctaaaacaaagtataattaaaaataaataaacaaaaatatgtacttggtcacatggagtctgctttataccatgctaccttttataataacctacatttttgaaatactgttcactagtttttaacctgacatgcaaaatataataattttgtccttgacatttatttcatgtctataatttagttggctttgcaatagcattttcgatccatttctaaacatttcatagaaacacagtgccattagccatttgcaaaataaacatcactaaattgcaaacaaagttttccctaatgaagtttagacatggaaattgattagatttaaaaaaaacggaaataaacacattctcttgcttcttggagcttattataaatgtctattatttctttttcactcaaaatttacattacatgtttgaagttaatacatcaatgttttaattacatgtttacattatctcctatatgtatatatgtgtgtgtgtgtatttatacgattgtaaacttatttttttgagacttgatcatttgagttacttgcttttattttcttaaatctcacaggccgggtgccatggctcatgtctgtaatcccagcattttgggaggccaaggtgggcggatcacccaaggtcaggagttcaaggccagcctggccaacatggtgaaacgccatcactactaaaaatacaaaaaaatagccgagcgtggtggtgggcgcctgtagtcgcagctcctcgggtggctgaggcattgagaatcacatgaacccaggaggcagaggttgcagtgaactgagatcacgccgctgcactccagactgggcaacagagtgagtctctatctcaataacaacagcagcagcagcaacaaaaagaactcacagtgcatcttgattcttcatatcgtttgttacatcatgatacagcttataatagttactatttaatacctgctaggggccaattctcgggctaagtgctttaaacacttcattcgacaaacattttttgagaacccactgtacgctgcacactgtgaagctacttggtttatcaacgagcaggacaattacagcatctgagctcagcaagtgcaccttctagagaaggtaaaagcagaccgaggtggagtgcggggaacaatttttctgactagaaaaggtcagggagcctctaaacagcatttatcatagagctgcgggaatcaaggacctcagtcttgaaaatgtggtatttaacctaagattaacagagtaagtagaatttagccaagtgaacaagagaatagggtaaaattgtccctagctatggacacgtttgcaaaaggcccagagatgggagagaacgtgttagtcaaagctgtttggcagtaaataatagaaatttaccaaaattatcttaagaaataaaaacaaatcaagtattgctgacatgagtaaaaagagtgagggagcgtgaacccaggaggtggaacttgcagtgagctgagatcgcgccactgtactccaggctgggcgacagagcgagactacgtctcaaaaaaaaaaaaaaaaaaaaaaaagggagggaattgattacaggcgtacctggcagaggggcttcactgatgtcactggattttccctgttgtctgtctcacacttccagccatttcccttattcttctgaaactccagttttaaaggacttcataggtgggaagattatgtaatttttattcaaattgggatattttaagagtaaacatgggtgctgttcatcactatctgagacaacaggtgcaagccagtactgtcctggataaggctgaacgtgtcatcaccctaattgcaagttaaaatttcattcttcctattacagtaaaggttttaatgaaaatcttctcctgttttcatacttcattctttaatttctgtttgtcacaccgctacatctcactattttgcccaggctggtctcaaactcctggcctcaagtcatcctcctgcctcgggctcccaaagcaatgggattacagacatgagccactttgcacagccggtgttgttcatgcttgagtgttgtctgtgtggtttgatgatgttgatgtagaaagtaaacaattggcgacctgcagatttcgggaggtggttgtaatggggttgagaattcctaagtcatcagcacatgcttcccttctggaactatgaaaatgcatggattccatggagatcctgctccccccttgtgaattattgacattgcctaattttgtacagtagattggaggtttcattgtgattcttagtgaatctatgtgtaatttggttttttgttgttggttttgtttttttagtgtaacatttcattctgtgcctgcacatgttaatctcaactgttgggagatgtggtttaactgtttgccacagttctattttagaactgggggcgggggccttgcctgctgacccaggctcagaggccacctctggctgatgttctccccacagggaagggagaatgtcctgggccatcctctgcgtattcaagaccctggcatcctggcccagatggacctgagcttgcctcgtagggttggatgggccttttctttgggcctctcctcctgagggtagacagcttggcttgtatctgaaatggtttgtcagagatacaaggagcatggaaataagagaagtcagcagaggggtcacaatgtcatgggttcactgctagcggttcacgagcaagcaggcggggagggggccaggagcaggaggagtctgcgtccaggtagcagaatttcagctatgctctccagggagcctgaggactacaaaccacagctaccacccacatcgctgtgaatgtacatttgtcaaggaaggcatgaggacttttacatatcaaatcacatggtctgtgagcctctttctgcccttgccctgcatcccacaaacatttaggggcaaatgagacatcacacctgacacctcacccaggcagcttctcaccatatttgtgctgttttgaagtcacttctgcccttagatcttcacttacaccaatacaaaaatgaatacatggttcacttgcatccacaaaggtaataactcttgccttaacataattcacttacaaaagttctataagcaataaattgtaagctttctaaaacacttttttctacagcaaaaaaagagagaaagaattggaactctaattccaaaaatttttaatcaaccgctaaaatggcaccatgaaagacagagctctcagtgtgtcaggggaatgagaaatccatgtaaatattgatgattaagaaaataaaaagtccaggcccggtggttcacacctgtaatcgcagcactttgggatgccaaggcgggcaagatcacctgaggtcaggagttcgaggccagcatggccaacatggcaaaaccccgtctctttcaaaaattcaaaaattagctgggtagggcagcacatgcctgtaatcccagctactcaggaggctgaggcaggagaatcccttgaacacgggaggtggcggttgcagtgagcccagactgagtcactgcacaccagcctgggtgacagagtgagactctgtcacaaaaaaaatacaaatttaaaaaaataaaataaagagaatgggggtgaacagagaatagaagagtttaatatgtgagagcgtgactgaggaactggcttcctggaggagaaactggcatttcagggtgacccaaataaggatttttgcaaagaccagataaaggagcatttcagggaaccgtgtagccagtgagaagtcccatgtgaggaatgagatcatggattccaaggaagaatgaggggctggtgtgggtgaggcacagtggatgtgtggcaggcagggccctgatcccacgggaccagcagatccaggtgtggagctagagtgatgggaatccactcaagggtttttaaataaagaagtgacatgaaccgatgtgccttcttagcagatcttcctagatgcagtgcagagaatggattgcactgggggtagacaagaaggaagttcgggcaagtgcgttgggggaaataaataattaaaaccaaaacttctgcctacccagaaaaacctctccacaaaagtaatagagaaaaaaataaaaacactattattgttgaataggctttcaagtagaatgcgattcatgtcactggcaatctgctaagaaattgcaaagaaatctctttcattatcaagcagataaaagtcattacagacttgttctcaagataaacagtaactagtcccctagcaagagggcttaacacaacccttggtcaacacatagtccgttctagatccacccagaaattggggtgatcatctgtggtagctgtggttttatatgaagaaaaaataaactttgtacatccttatgaaaggaggccgttttgcaacttggagtcaggtgcctgcggaagatttaggctcctgtcctttcctggaaggggtaggcatgggcgctaccttccttgatgatgcatttcaaagagatggcctcagatcctaaggaaagacattcctaggtcttaaagctgacaggaggcttatttagcttttgtaaacatccacatacatttcaaaggaactgagaaagtacttccagttgtaggttttctaaacaaaatgctctaagaaagagagggggaaaagtctggtcctttatctcctgcagggagaattcagcctctcacttttgttttgcaaatgcccttacacaggctcctagtgactgggacccaggtaccggaaggaactggaggtgcttctcagggtggcaggatgtgccctggaatgaatgtttgctgtggacagggaggactcaaggacaactactaaggttttgatttgagcaactcagaagacaggagtgccatttacagagagggcaaaatagtaaatacaaactcaattaatgcattaatgcagaaattaacgaaattcatgatctgctttacaaattcacaatgctaacacgtcccctttcctccacagttgaccttctaaaataccctcctgtccttttgagcaccaaattcagaatctccctcttgaggaatcacagttcttcttggaaatagccaaaaaataacttcaggatcacatgttcccgaagggagtcagttttacttctcagcgcccttggggtggaggactgggctgagagtcaggtcctaaaaatctgaggctgcttgctgccaagcagtgtccctgctgaagacggatcccgcacccatctgtgactatgatgcttggagggtgtgcagatactggatttccgcttattactttatatccctcccattcaacccttgtttcccaaatagcattcacttttccattcaccgtccagggtgataaagggctcagattgtcagccacattcaaggctgaatcaaagctgcccccaaaatgtttcaccctggctgtcctgccttgggttcaacgtgtgtctatgatttccccctttgaagagctgatgtctgcagcgacctaggttagaggcgacccagatgtatgtacagtgtaaaagctggtgtacttggctgggaccttattcctttcttcctggaaagactgcttatgcaaactaaccctgctccacctggccattaaaaagggatggtctctgttaaacaaaagcagattgctctccagggtaatgggggaggacacgtcctaggtttgcataactaagaggacctccggagtgactgcctgattcctaaattgccgcagcctgactccagtgaacagaaacaaggagcttcgcaggctactgaccctccaaaatacaggaaaagaaagaataaaaagtgttccaccagcctcgcaatagcatctctgcctagccaggagccaattctactttataaacctgatttcgaacccaacagctttccttcacgtgttgaacgacagagggtctatgtaatgcgcacgttgtgatctgtgtactagatgcgactgcttctgtatattggtattgctttatgtatttttctacagatgtgagaagcattttatctatcgaggtacgcagggatgttttaaatgatgcgtatgctaagcaaacgtacttctatgaactaatacctcggtcaacaaataaaattttacataacgtttaaaaaacatgtatgtagttcatgcatttaatagactgtggccccaactttgttttagcaaaaaaggaaaataacaaaactttgcatatacatataaatataatattcatcatataattatatataaatgacaatattatatataaatgatattgtttatataaatacataaataatatttgtaattttcataaataattatatttattgtcaggcctgtgagcccaagctaagccatcatatcccctgtgacctgcatgtacacatccagatggccagttcctgccttaactgatgacattccaccacaaaagaagtgaaaatggcctgttcctgccttaactgatgacattatcttgtgcaattccttctcctggctcatcctggctcaaaaactcccctgctgagcatcttgtgaccccctccacacctgccccccagaaaacaaccccctttgactgtaattttcctttacctactcaaagtctcccttcagtgactctcttttcggactcagcccacctgcacccaggtgaaataaacagctttattgctcacacaaagcctgtttggtggtgtcttcacatggacgcgagtgaaatgtggtgctgtgactcggatcgggggacctcccttgggagatcaatcccctgttctcctgctctttgctccgtgaaaaagatccacctaccaccacgggtcctcagacccaccaccccaaggaacatctcaccaattttaaatcgggtaagcggcctcttactctcttctccaacctccctcactatccctcaaccactttctcctttcaatcttgtcgccacccttcaatctctcccttctgttaatttcaattcctttcattttctggtagagacaaaggagacacgttttatccgtggactcaaaactccggcgctggtcacggactacggaaggcagcctccccattgcagggacatctctctgattgttcacccacgtttcagaggtgtctgaccactcagggacgcctgccttatttccacgccccaacctcttatctctgtaccccgatcccttatttctgcgccctgacctcttatatctgcgccccaaccccttatttctgcgccccaacccctttcccgcttgtctggagggtaagaaaccccgaaccccttccctccatgtctctactctctcttttctctgggcttgcttccttcactatgggcaaccttccgccctccattcccctctcttctcccttagcctgtgttcttaaaaacctaaaacctcttcaactgtcacctgacctaaaacctaaatgccttatattcctctgcaatgccgcttgaccccagtacaaactcgacagtggttccaaatagtcagaaaatggcactttcaatttttccaccctgcaagatctaaataattcttggcatagaatgggcaaatggtctgaggtgcctgacgtccaggcattcttttacacatcagtccctacctagtctctgttcccatgcaactcatcccaaatcttccttctttccctcctacctgtcccctcagtcccaaccccaagcgtcgctgagtctttctagtcttccttttctacagccccatctgacctctcccttcctccccaggccgagctaggtcccaaatcttcctcagcctccgttcctccactctataatccttttatcacctcccctcctcacacctggtccagcttactgtttcattctgggactagccctcccccacctgcccagcaatttactcttaaaaggtggctggagctaaaggcatagtcaaggttaatgctcctttttctttatcccaaatcagatagtgtttaggctctttttcatcaaatataaaaatccagcccagttcatggctcgtttggcagcaaacctgagacgctttacagccctagaccctaaaaggtcaaaaggccgtcttattctcaatatacattttattacccaatctgctcccggcattaaataaaactccaaaaattaaattccagccctcaaaccccacaacaggacttaattaacgtcgccttcaaggtgtacaataatagaatagaggcagccaagaagcaacatatttctaagttgcagttccttgcctccactgtgagacaaaccccagccacatctccagcacacaagaacttccaaatgcctgaaccgcagcggccaggcgttcctccagaaacacctcccccaggagcttgctacaagtgccagaaatctggccaccaggccaaggaatgcctgcagcccaggattcctcctaaaccgtgtcccgtctgtgcaggaccccactgaaaatcagactgttcaactcacctggcagccactcccagagcccctggaactctggcccaagactctctgactcactccttcccagatcttctcggcttagtggctgaagactgacactgccagatcacctcggaagccctgtagaccaacacagatgccgagctttaggtaactctcacagtggagggtaagaccgtccccttcttaatcaatatggaggctacccactccacattaccttcttttcaaggacctgtttcccttgcctccataactgttgtgggtattgacggccaggcttctaaacctcttaaaactccccaactctggtgccagcttagacaatactcttttaagcactcctttttagttatccccacctgcccagttcccttattaggccgagacactttaactaaattatctgcttccctaactattcctggactacagctacatctcattgccgcccttcttcccaatccaaagcctccgttgcgtcctcctcttgtatcccctcaccttaacccacaagtatgagatacctctactccctccttggtgaccgatcatgcaccccttatcatctcattaaaaactaatcacccttaccctgctcaatgccaatatcccatcccacagcatgctttaaaaggattaaagcctgttatcacttgcctgctacagcatgacctcttaaagcctataaactctccttacaattcccccgttttacctgttctagaaccagacaagccttacaggttagttcaggatctgcgccttatcaaccagattgttttgcctatccacccagtggtgccaaacccatatactctcctaacctcgatacctccctccacaacccattattctgttctagatctcaaacctgctttctttactattcctttgcgcctttcattccagcctctcttcactttctcttggactgaccctgacacccatcaggctcagcagattacccgggctgtactgccgcaaagcttcacagacagcccccattatttcagtcaagcccaaatttcttcctcatctgttacctatctcggcgtaattctcataaaaacacacgtgctctccctgccaatcgtgttcagctgatctctcaaaccccaacacctataaaacaacaactcctttccttcctaggcatggttggatactttcgactttagatacctggttttgccatcctaacaaaaccattatataaactcacaaaaggaaaccttgctgaccccatagatcctaagtcctttccccactcctctttccgttccttgaagacagctttagagactgcccccatcctagctctccctgtctcatcccaacctttttcattacccacagctgaagtgtgggctgcgcagtcagaattcttacacaagaaccgggaccgcaccgagtagcctttttacccaaattacttgaccttactgttttgcctagccctcaagtcttcttgtggcagccgccaccaccctaatccttttagaggcccttaaaatcacaaactatgctcaactcactctctacagttctcataacttccaaaatctattttcttcctcacacttgacacatatactttctgctccccggctccttcagctgtattcactctttgttgagtctcccacaattaccattgttcctggcccggacttcaatccagcctcccacattattctggataccacacctgacccctatgactataactctctgatccatctgacattcaccccatttccccatgtttccttctttcctgttcctcgccctcatcacgcttggtttattgagggcagttccaccaggcctaatcgccccacgccagcaaaggcaggctatgctatagtactagccactagcccgcctcttagaacctctcatttcctttccatcatagaaatctatcctcaaggaaataacttctcagtattccatctgctattctactacttctcagagattattcaggcccccacccttccctacacatcaagctccaggatttgcccctgcccaagactggcaaattagctttactcaacatgccccgagtcagcaaactaaaatacctcttggtctaggtagacactttcactggataagtagaggcctttcccacagggtctaagaaggccaccatagtcatttcttcccttctgtcagacataattcttcagtttagccttgtcatttctttccttctgtcagacataatttctcggtttggccttcccacctctatacagtccaatagcagaccggcctttattagtcaaatcagccaagcattttttcaggctcttggtattcagtgaaacctttatatcccttacgctcctcagtatttaggaaaggtaaaacggactaatggtcttttaaaaccttaccaagctcagccaccacttaaaaaggaatagaaagtgcttttaccactttcccttctcagaattcaggtctgtcctcagaatgctacagggtatagcccatttaaactcctgtatagatgttcctttttcttaggccccagtctcattccagacaccacaccaactttgactgtgccccaaaaaacttgtcatccctactatcttctgtctagtcatactcctattcaccattctcaactacttatacatgccctgctcttgattacactgctggtttacactatttctccaagccattacagctgatatctcttggtgccatccccaacctgccactcttaacacttaaagtaaataaataatctttgctggcaaggctatgctgaacctcgtcaggcactctctaattagatgtcctgggtggtcccaattcttagtcccttaatacctgtttttctcctcttattccgtttagtttttcaattcatacaaaactgtatccaggccatcatcaataattctaaatgacaaatgtttcttctaacaaccccacaatatcaccccttaccacaaaatcttccttcagcttcatctctcccactctaagttcccatgctgcccgtagtctcgctccaagcagccctgagaaacatcgcccattatgtctccataccacccccaaaaatttttgccgtcccagcactttacaactatttcattttatttttcttattaatataagaaaacaggactttcaggcctctgaacccaaactaagccatcatatcccctgtgacctgcatgtacacatccagatggccagttcctgccttaactgatgacattccaccacaaaagaagtgaaaatggcctgttcctgccttaactgatgacattatcttgtgaaattccttctcctggctcatcctggctcaaaagctcccctgctgagcaccttgtgacacccccacacctgcccaccagagaacaacccccctttgactgtaattttcctttacgtacccaaatcttataaaacggccccacccgtatctcccttcggtgactctcttttcggactcagcccgtctgcacccaggtgaaataaacagctttattgctcacacaaagcctgtttggtggtctcttcacacggacgcgagtgaaatttattatttaaatctgtattatatattataaaataaatatataatatatagcatatcataaaataaatatacaaaaatatataagtataattataaaaattatatttatagtataattataaaaattatatttatagtataagtataattataaaaattatacttgtagtataagtataattataaaaattatacttgtagtataagtataattataaaaattatatttgtagtataagtataattataaaaattatatttgtagtataagtataattataaaaattatatttgtagtataagtataattataaaaattatatttatagtataatttaaaaaattatagtataagtataaaaaatatatttatagtataagtataaaattatatttatagtataagtataaaaattatatttatatgcaaagttgtgttatttatataatatataaatatataatatttaatataaaaatattatatacttttatttatatgcaaagttgtggttttttggttttttgttttgagatggagtctcgccctgttgcccatgctggagtacaatggtgccatctcagctcactgtaacctccacctcctgagtctcctgcctcagcctcccgagtagctgagattacagacacacaccaccatgaccagctaatattttgtatctttagtacagacagggtttcaccatgttggtcagactggtctcgaactgctgaccttttgatccactcgcctcggcctcccaaagtgctaggattgcaggtgtgagctaccgcacccggcctgcaaagttgtgagactatatatatatctctcttatctagttgcaaaaagattggcgttattgcagcgtccagttctgcagtgcagtagccgcacgttgtcaatcctgctgttggaaacagtcagacccactgctgttttgtgaagggcagcgcaggttctttgttgctcaagctgactggcatggctctggatgcagcctgacaggtggcagagatgtcccctcagaggccaatgggcctgtggaaagtgcctctgtgacttgagattttccagggaacgcctgtgggaaactggaaaacagggcactcataatctcaggaacagcgctgcctttttctagggtcgttgagggataagatggatgcaactgaaaatgttttcttttttatggcaagaaactagaaaccttcagagtcagcaaaaaatccaatttgcagaaaacatatttaagagaaaaatgagtgaagtgtatgatgtggcacataaaagaatacagccctggaagaggaatgacagcgtgctctgccaatcactttgtgaagagcctgaagtggaaaagcagtttctgcccctaatggagtgcccctgggtgggggtttgtattagtctagaataagctttcttgcctttaacagaaaacatctttgcatcattcataactagaggaaaataaaatgaaatttgtttcaaagacccaaccgatgtattctgcactacattgtttaaaattgttctctttctccttcctcaagccttcttattggttttttagtccaatctggctaactctaggaacttttcatctttatttcataattctaaatacaaagtgtttgggggtttgtttaaacttaagtaagccttagtagtttatggcaattttaaataacctttgaaaatatacaagcagatatatacattagctctaaatgtatatataattattttattgaaactcacattttcggcgaggcgcggtggctcacacctgtattcccagcactttcggagtccgaggcaggcagatcacaaggttaagagatcgagactctcctggctaacatggtgaaaccctgtctctactaaaaatacaaaaaaattagcctggtgtggtggtaggcgcctgtagtcccagctactccggagactgaggaaggagaatggcgtgaacccggaaggcggagcttgcagtgagccgagattgtgccactgcactccagcctgggcgacagatcaagactctgtctcaaaaaaaaaaaaaaaaaaacttacatcttcatataactggcataaactcgagctaattatgtagatgcagtatttctgtttattagacaacatgaacttcacaagtttaaaacttttaattgcatgctgcattattattgttatacgtattccaaataaaaattgggttgagaactacaaaaggtactttcaaaaatgaatagaatattataccatgaaaggacatgtaaccactagtgcaaggcactgtttctactgatattctgtggacttctatttggaaggatcttaagagattttctaggaaaactgtgctctatgatgacaatgtgggatacgctggattaaacaatgatttttagaagttttttactgtggtacagctctgagcctttaatccttaatgtgcaatgggaatgtctaaggggaaactggggtgtgcagtatttgccaatctcatttgaccagatcctattaactcccagaaaagtgttcaacagagcacttattttttgcaaggctgatatatccgttaaaattcttattcatgtataaaatctgtgcacctttgtgtaaaactttcctagtagtgagtattatatatcttttcttttgataaacattaaataaaaatatgggaatgagaaatgaaaacatcttggttttaaaaattataatgaaactgttatccctgatgtccttggctcacctcctaaacttttgtttttaaattcttgtactattatataacattcatttcattgtataaatgttgcgatatttacagtgactatcactgtatgacaattattttaatattatacacttattgttaattttttaacctatataaactgtgacagaaattatcacttgcaaatgagtgcttaattatacatgtcaccacttgcttgaggaaaggaagaattttcctttgaagatgggaagttcattcagatgaacaagattgtgcatgtacagtaggatttgcttttgattattttctgaaaaccagagaaatctcaacaacagttgatcatagattctataggaatatcactcaaagagtaaattcaagaatttgtgtaaaatgctggttcaggaagggtacccctttggtaccaagatgatggccaattgccttgtgattctggtgattgtattctatgattagtgttctacgttagaaaaatgtgtggcttatgggtgagaccttcgtgactttctaactgtaagtgttgcatcttcacatctatcctgccttcctctgctctcccaggcttctcttggagtaatatgcttggatttccctgtgttccagtctttgcagctgatgggaggaaagtgggaaagtacagcaatggccttccggtaactcctattgtcattcccgctctctttccattgaaaaacctactccgaaacccaagcactctcttctagatctccactgagagtgctgttttcaagtgagattcccctgttcaaaacacgagtaatgataataatactgataatgacgagaagaatgatgtctcagaaatcatggccagtgtttaagaaataagtgtgattgagtggcttccgtttgcagtattacagtgaggactctgaaaatttatatgctgaaaatacagtaaaagtgctggataaaattggttttggattttcaaattgtgtcattgaacctgcaacaaaataaggaatcccggttgatatgaaatgcagaaatggagagagattgtgaagctaggaagccagccctgccctgattgcctctgctgatcctctgtgatgtggagcttccactctcagagtcccttggctcagggaatagaaagcaaatctaaggtctttctgaggttgaaaatatcataggagaccctcatgtatagctggaacaccaaagggtgttctactcacagagtggggagaatacacagacatcgatgttgacagagacatagatgcatgcaactcacaaccgccggcgggattcacactagtctgtaggtgaatttctaccatccctgggatccaaaatgcctcaagctgttaatttatttttgaaaaaaggaggttttctgttgttccaggcagatcctgtaatctaatgtgactctcctctggatgggtgtaccttcaaagcagaatgcaaagaattaccataagtcaagttccccagaacagaagtacaaatgtgaaaacttacaaacaacttagtttacatgagaaattggaattcttatcggattcagactgtaatcatgaaaaaaaagagaataaaaatatgaataggaaaccaaatactatatgaacggccaagtaaatgtgaaactaatccaagccatcacatgtccttactaaacataacttgcaaaaaccaaccaaacaaaacaaaacgaacaaaccattttagtgtattagtctgttttctactgcttataacagaatatctgaaactgggtaatttataaagaaaataaatatacttctcacaaatatgctggctgagaagtccaaggtcgagggaccacatctggccctcttgctggtggggattctggagtcctaacgtgtgcaggcatcgcctggcgaggggctgagcatgccagctcaggtcactcttcctataaagtcaccaattcccctcctgtgatagcccataaatccgttaatccactaatttacaaatgattaatacaatcacctcttaaaggcctcacctcccaatatgaccatattgattacatttcaacgtaagtttttgaggagacaaatagtcaagccatagtatttatgaagtagaaaaattaggccaaataaaaactcagaaaaaaaaaatgaaaagaaaacataataagcaaacaaattgataagtatgtatgaaaatttaaacaatcatcagtcaactatgtcaaacaataatatttaatgtatgaggtttataaaaacaaatggacaatgacaatgtctaatttaagattttttttttaaataactgaaatacctagcaatgcatgtaattaggaagagaataataaatattaaagaagaaggtaagactattacaactaaatacatactgaaatttctagaaagtctactaaaataaaagcacgagaaaaaattaattagtatgaaagcaagcaaaaaggtagagcatatgggggtgcacatagaaaacacaagctaagatggtcgagagaaatccaaatagagcaggaacttcagggcacataaggagactaaactatccaattaaaagacaattctgggattgaatttaaaggacaatctaactgcatgctgtttggaagtgaaaatccaaaacatagcagcccatgtcatttgaaagagcaaatgtgtaccagcagcatgtacaagagttttcgcagcagcattttatataagggtaaaaagaaaaatgacccaaagatccatcaagaagaggatggaaaaatcatggtgcattcctgcaatggaaaactatacagcaataaaaatgagtagaccagagcatcatgcctaaatgtagatgactcccaaaaacataatacaagcaagggggagagagacagagagtcacagaacttgcaatatgtattccagttaagcatttaagacagagagagtcacagaacttgcaacatataattccagttaagcatttgatttcaggaaactgatatatgtggctaaaagtggaatgcatacatttatagtcactgtgaagaaaagcaagggaatgataaacataaaattcagaaagtgacttcccctgaagtggaggaagaaggtgatatggggaagggtatgttctacgcattgatcatactgatgtattggtaaatactctattgcttagagttggtagcacagatgttcatttcattgttctcattgtgttatagatacacacatgtatatatttcaatgtaataacaatcaatttgagagaaagagagtggtgaagacagcttcttgcctcaattagcttagagaatagcaaggagaaagacaagttagcaaattttcacacttcatcttcatagcagacttaatgacttagatattagtctaatttttactgatttgttagctgatgataagtgtgcttaagtgatcattaagtactaattaggtactaattaagtcctgatgggatttgaagcaggtctgaccaactataggatccttgatgtctgtatcatatgacactattggatagagctttggtcttttaatctgcacagtttaacattttctcttgtcctgaattatttgttcattgccacccctattaggttaaaaatgtctgaataacacagagcaggtcttattcttttttatatatcttctaactttttatttaaatggattttattattccatttatctatccatatgtagacatatgtatatgcacacacacgcacacacacaaatgcttcagaatttacaaaacaaaacgcaaagcctactcattactttaaggcttcaaatattaaaatggacagtgtgatggtatgtatatagaacaatacactaatctctttttttttgctctttcataaaacttggtgttgaaaacagtgaagtactttgcagagaaaaagtcagcttttaattgtcatctcttatgcagtggagtggaagaaagagctcgttattctaactgaaagtaaaaatgagaaaaaatctaagctttggatttttcaggagtacctatctttctaattttcagtgcgacacataatacacagcagttatagaaactggagaaaacaactgctatttcttgaggctgctgtattttagagtgatgggggatactctggtgaaaactctgggcttgcggtagccttctgtgattaggcgcaggcagagtcgatggctgcatatgggaggtgattttaggctcgccgtttgcaatgcactttacacatgattaccagaaactgatatgataaggctccagtggcccctgaaagcacaggcaccagccggctttgcagagtctggcctctactcagcagatttgagattctttatatatatgcagaaaggcaggatattattttcagagcttttgttaatattagggtggccatataatatattgtccaacttggaattttttgggtgagtgaaagggggttattaataattttgccgtggcaatgtcacctatgggatcctgggtataactcactggtcatctcctctagaccttccacccttggcatctcaacaaaggttattggatcacctttgaaggcacagaccttaaggaaattcttcctattttgttttccttgaggttggtgtactttaactagtttatgtaatttgcagtatggggtttcattaaaatattgctgaagagaaaatcagtctgtgtgtatgtatgtatttattctaaggataatgtaatttttgttttaaaaaaacccttgatatatttcatcattggttgcattttcaacagaatcttgctagagtttatgcaatgcaagcacaatgaagatgtatgttattgaatgtacccctgggaaaagaaactattttcgtatgttcatgtgtagacaaatgacttattaggccaatgaagagtgcttcaacccacaagaacaaccacaccgacaagaatgtggaaaccatgttttccagcctgtgaccttgccttctcttttgtttgcagcctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcataggtatcagacaacagaacttagaaattttatattcaggaatggatgcatgttgtcgttaaaagcgctccgtaaatgtattatttcttcagaaatatttctcaagagtttctttcatgttctctggctctctgagactcctgaaattttattgtaaacctttaaactttattttatgaggtagaataaaggaagtcatccccttaaggtacagtaattgacatttaccgtatatttcctacccttaacaaatgttacataaacatggatcaatcaaatgtctgtaatttaaaattctagttgcctcaaaatttataaacctaccattgctattctgatttttaatatagaaacatgcccttaagcaaaacctactcactaaaagtactttctctttttagatgtttttccccctatgatattagtacatttaaaatagaattctgaaaactagaaattatactgtttgtgttaaaatgaagataaaaggaggtttgtttctgaaatttattgacattttatagtttgaccttattaaaaggataacaaatgattttgcagactttggcttgaatagccacctgagacaatttatcacaaatatgtttgtaggctaatatatattttatgtaaaatagtaattgcaggtagattgtctcttcattcaataaaatattctactaataaaattcgtacttagagtatatcatctaagtcttaaaaagaaactactgaactttattattttaagtaactgtcacagtttaattagtacttctttataatctgtctgaaaaatgtaaaatttaattgatgtgtgaagagagaaagtgatcatgaaatggataggccattttgcataggatgaccttgagggggtttgtggtttgaactggtttttattgtcgtgtacacagcggtggtgaaattctcagtggtcttggggagctgtgatacggcgctcctacttatgacaaaccacttatcccagttgtctgaagacagatgaggttggatagctgtccttatcagccttctcagccttgtcggggagcaatgtatgtgtgtttaatgtctggtgctgcgtttacttttcatagcgtctgtgagcacagtcacgcgttttactcaagctgagtcaccgggagactgcagagatttcggcgtgtttcttttttaaagtggagtgattgcctatcaatgtggcgatcattttaaaccaatggcctacttttacagtaggaaagggtttttttttttccttccattttgcatgtttttaggctcgtggaggaatacattaaaaagcaatataactacgagttaatcccttaaaagtaatttattaatttatattaatttgaacatgtaattataaaagttggccatctcctaatgaatctataaacaaatcgatcttctgttagatcatctcttagttactttattttgaccagccactaggtagtccaatacgcaccaaaaggtaaataaatacccctgtctctaccttgaatgtcagcttcaaggacaagctgaaatcacttgcaggcagatgaataatcaattattttggcaaccagacccgcctacatgcgtaggtgttatgtaacagaaaaatggaaaatatataattggaaataagttaacattatatttttattactttgtaattttctgttttttaggaatgaggtttatgtcctctgtaagaagcttgcccattagggcatgagttaattataattagcactcatgtaaattctgtttcaaagattcaaaacactttttaatttttttaccttttttcatattaaagggtaatacattttactgaagacattttataaactataattaaatcaaagaggagaaaaaagttgtcatctttttacctggagacaattacaattaatatagacatttataaatgatttcataattatgtatatgtaatccattttaaaatgttttagtctgggtgtggtggctcacacctgtaatcccagcactttaggaggccaaggcgggcagatcacttgacatcaggagtttgagaccagcctgggcaacatggtgaaaccctatctctactaaaaatacaaacattggccaggggtggtggtgcatgcctgtgatcccagctacttgggaggctgaggcacgagaatcacttgaacccaggagctagaagttgcagtgagccaagatcgcaccactgcactccagcctgtgcaacagagtgagactctgtctcaaaaaaaaaaaaaagaaaaaagttttaaaatgacaacatcctgcttgactgtttcgtaaattgcactttttacttaccagtacatggtgtgtatattttgtgttactatgtattttctactcgtttttagtgactaaatctttttagaaggcacaactacaccactgatgccactctctagtatctatttgtttgaatctaccaatattgatctttctagtcccttattattgtataattaagttgttttaaccttttccctattctgaagatagcttcaatgagcactcatgttgcaaaataaatcaggattattaataagtgacatatttctacaaactcgcatatttctcggacttttaaaacgtgtttgttttgttttgtttttgaggtagagtctcactcagttgccgaggctggagtgcaggggcatgatttcgactcactgcaacctccttccgtgttccagtgattctcctgcctcagcctcccaagtagctgggattacaggcgcccaccaccaagcccggctaatttttttgtatttttagtagagatgggttttcactatgttggccaggctggtctcgaattcctgacttcatgatctgcctgcctcagactcccaaagtgctgggattgcaggtgtgagccatcgtgtccagcccatttttaaaatctctttcagagcagtcacaccgatttaacctgccatcagccatatatatttattaatgttttctctgactcacagaaaacaccacactttatagattttaaggcacaaagtgatgatgtcttgttttaattggcattttaaattaataataaggtcgaacttttttttttcatatgcttattggctgtttgaatttgttctttcctgattgatcagctaatttacttttttactttttattattagagtatatttactcattactggctctctctctttctttcccttttataaaatctcttaacctctcacctgttgtgtgtgacaacacttattttcaacacctgccattgctgttgctttttcttgagtgttgcttggatacctcacttttttgttgttgttattgttacatccgaaatgacttctaccatgaagcctcctctgtttagctttttgacttagtctagaaggagaattctgtagaccaaaggacattaacgacttttttttttttttttttttgagacagagtcttgctctgtcacataagctggagtgcagtggtgtgatctcagctcactgcagcctccgctcccaggttcaagcgattctcctgcctcagcctcctgagtagctaggattataggtgcgtgccaccacgcccggctattttttgtatttttagtagagactaggttttgctatgttagccagactggtctcgaactcctgccctcagatgatccgcccaccttggcctcccaaagtgctgggattacaagcgtgagccaccacgttcggcttcaacttccttattccgagtaaagtgtccctaaaaagtcttcattatcttatatagcctgcaattgcttttccccaagtccaaattgcaaaacactctgaaaagccaaaatgtatcctaggtttgcagaaattcatttagggacaacagagcatcctgacataaaggtgtctatttagaaaatatttatcgcccccaacggtgtgaacattcaaatgttttaatgcagaaacgtagatgggtctcgttaaagaccagcttcaaaccctggtggtgaaggagctgctacgtatgtatgtgtgctgttgagcatagtggataaaggttttgtaaaagggttggtgggtcgaaaagaataggtggattttatctctttgtctattccttctggagaatttgctagcatctctgagttgcattttttactattctaatcctatctaaaatattttgcaagctaattaaaacctaagcaaactaacttgaagaataccagaccaaaagagagaacaaacagggccaggcagcactccttaattccactttttcagcttttaaatcacctcatttgaaagtgcctcctgggatcagtgtgaataagacagggtttcccctttgtttcttttaaatcaatatttgaatcatatccctgaactcttcctgctggtagcaccctgtagccagtgccctgaatctgtcatttttcatcttacaaaacctgtgtgcagtagaatcttctagaccttcaggtaccttctttctctgcatcagctcccgctccctgatcggtccacgcttgtactgctcgatgctgtcagcagccccggcgtgattctgaggaggcactgccctgtgagagctgttgggacaattgcttctgcacaattcaaattcattaaaaaaaaaaaaagtcatactggggaaaatcaagttttaatctttttctgtaaaaattatatcatattactcttgaacgtatatctgtggaatttattattataaatgttttctacaatagcattcagagtttgcattcagttagactgtgagagtataacaagaactactggagttagttgttatttcttcctataaaaagctaagttttcagaaatgttaaataagtatttaaagaggcactccttattgaaaattgtgaagcatgttccttcatcttccttcatcttatttacaaaacaaagtctctttttgtataggggaaaaatcagcaattaagacattttcttttctacatattttttagtgcatgtgtgaccaataatgggaatgaaataagacatataatttaagtggaatactatgatttaattgtagtcacgctttaaaacaacttggtgacaaaccacagtatttgatataaacaacttttaaactcagcatagtcttgtatgtatctaaaatgtgtatacttataaattcggcagtgttttcacaccttccgtgagatgagaggtttaggagaaaccttatctcacaaataaaacaatcctaaatactttccaattcaagaacaaaaactggcttgcctattaaccacattgagctacataattactgccttgctaatataaatgtaaacacatttaattcaaaattgatgacttcaaacacaaactaaatttgttattatcatataaagtggttctttctaataatataccaagcattgtgatcaaatgatattttcagagagtaatgctccagctcagctcctcactgatatgtatacttagagctcacttaaacttttggggtttgttttgccactttgaaatatggggaaagtaattcaagccttccatacaccaggggactgggagaatgtgaaatgccatgttttcatgtacccaataaccatttcctgaacacttgttcagatccagaaaccgcctagacgtttgggataaaacaatgaacaggagctagatgatccctgtaccacatgaagcatgcactcaagaagaaataggcaatgattttataaactgtgagaaatagcaaaataattaacatggccataaaatcatgtccatgggattttttttattcaagtgtttttctgtttgtgcacatgtgtgcacgttggcaggtatggggattaagtcatctttcatttaattgagaaaattttaaattataggaaagaaattttttgtgtcagaagtttgaaaattctctttgaaaatggggtggaatattatgtaaaattcattaacagttacatgaaaaatgtacagagttcctgggtcttacaattttatcaggataattgataaccaacacacaatctcttggactggtaaaaatgctgatgtctttttcttaaagaattctgtggtgtctccttccacactgactggcaggcgttcttcgctgtccttactttttctctgtaacttttgttctgtgacagctgcttgtggagggaatctgacgggcccagcaggtgttattttgtcacccaactacccacagccgtatcctcctgggaaggaatgtgactggagagtaaaagtgaacccggactttgtcatcgccttgatattcaaaaggtaccgtctcttgcagaatacctctttttagtaggatttttaattccatacctaaaaattacttcttttatgacctcatagtctctaatgttatatctaggtaagtgctagattttgtgtctaatggagactacaccaggctgcaaaatgacataaatggaaatacagtattttgctttggggcattctacttaagatgcacttgaattatttttaaatactgtttgtcttgcacacaatgtgtcccatatgagaaggcttaaacagaatgttcgttaaaaataataaaaatatggtatggagacatttggtgtaatttctcatcaatgtctcctatcactctaaatgcctgatagtgaattcctttccacagcacatcctgacgttcctgagggtagcactgctaatatcattataaaattaagacttaatagagcctggaaaatgaaagtttccccaaatgtggttgctgtaaagtctgagttactacatatcagtcctaaaaatatgctaacttgtacttgctaaactagacgatggaaggtctaatactgtagtcattttatgaaaataaactctttaaataattatattattagtatatggtatatgataattacaatttattgaatccaaagatgttttctaactttagactttgacttttgaactaaatgaatgtgttgtttatgaaggtgagtcattctgtagactttcctattgacctttcagctatccaaggacaagtatctgggattacattttttaatctgtcaatggaacgactttccttttctgcagatctttatgtcagtattcaaggcctgaatgtgtttacataccctcactttctcctcctgatgagatctgagtcagtagaattttacgtttctatgattctgaatcttaagttggttgatagtcatcttttcctgaatttactaaactgccacaaatttaccaaatgttactcagctattacagaaaaccagtgaacactcactggctatattttttagatatctatgtgggttttgttaatgttaaattctagtagcgtcttccttaaaattaggaggcacctctggtttcaagatattataaatgggttaacagttgaagccaggcatggtggttcatgactgtaatcccagcatttcaggaggccaagatggggagcacttgagttcagaagtttgaaaccagcctgggcaacacagcaagactccatcactacaaaaaattttaaaaattggcttggtgtgcttgtgtattcctctggttctagctactcgagaggctgaggcaggaggactgttggagcccaggaggtggaggctgcaatgagctatgagtgtctagtctgagctgagcaacagagcaagaccttggctttaaaaaaaaaaatgaaattgaacacaaaaccttgttagtaggagtttcctccctcccataaagtgcaactcatttgatgatatgcatatttaaggcagttttgtgcaagggttttttcactgcgttttatacacccctctggaagtttgaaacagataatctctaagcctctcccaacccatagattatgacttattagccgacccaatgtctcagaaacttcagaaatcagtgaaaaccagtgacttctctgatctggagtttgcatgtgctcaagcagacatctacctgggaagtagtgaggagggagagaccagaatcctgttaggggatgaggatgtccagcttcccaagcaggaggctggcgctgatgagggctggccaagatgcagtgtcaggatgatggcaaattcaggtgtgttttttttatgggagggtgggagtctggcattactaatggtaaaggcaaagaatcatatgacctgaaggacatatgggctcccaggctcgttcagggctgtggatgagagaggatgttccattacacgtccctgtggattgtggggctcacacattggggctcaaattgaatttggttcaatttgagtcaggctttggcatgctgtaagagcttagagatacgtgcagctggcagaggtagaaataaggagttctccaaaggagccaaaattagttataaatttcactccagacttctacgcatgaattttggtacaggcaaaaaaaaaagagagcagatgggatatatagtgtttgtttgtttgtttgtttgtttgtttgttttcctgtgtctggcagtatttgcagtattgcataaattaccaataatgataattaactaagccaaatattggggatatgacatgaccagattttaataacatccttgccaatactctaaatacaattattattccaataaaattctacgtaacccacaccattcctgctagcgcctatacctagtaactccaaccttttattccttcttcattcctgacgtcagtgaacttgtcaaataaacagactaagacaccttcctaaatttcctttaataagtatattcaggatgtggagtgagggtatccttgacccaaaacaggttggcataatgcaggctgggcgttgcaccgatgctggcggtaccacgttctctgttccccttcatggtgcagtggacctttccaggagggaacttctgttgctattttatcatccgaatctccagatcaagtggagccacctagaacattttagtgattacaaaacaaacaaacaaaccaacaagcaaaaaccctgaccttctctgtctcagttgtcccaaatttctgcagttggaaaggaaagggagtaggagctttgtaaattgagtgctttttaaagacacatatgaaaaacctgctatagagaagaagagggaaggggcagctgcaatggatggattggttggttgcttggttggttggttgattggtttttgagatgagttttgctctgtctgtcacccaggctggagtgcagtggcgtgatcttgactcactgcaacctccgcttcccgggttcaagcgattcttctgcctcagcctcccgagcagctgggactacaggtgcacgacaccatgctctgctaatttttgtatttttagtagagagagggtttcaccatattggccaggctgttctcgaactcctgacctcgtgatctgcctgcctcagcctcccaaagtgctgggattacaggctagagccactgtgctctgctgcaatggatggttttaatacttctactttatcagtttattctggtcatatcaagatcttagacatcttaaccaagctcagcctttctcttagagtgtgcgtagttttaaagctcagagactctatcagcctacacatcaccaatggcaaacacagcccagcccttgacacctttgaatttaaattgttacactctttggggactgactgtatgttaatattagagcagagagaaacagaaaaatggagaaagtgagagaaagaaagagagggacagagaaaaaaaactgggatattcagtgatggtgaaacatgatgtgagaaaggttacactctgggcattgtaggggctattaatattcgctgatttatccacgcaagtggagtctttttttttttttgacagggtcttgttctgtctctcagggtggagtgcatgggtgcagtggtgtggtcatagctcattgcagcctcagactcctggcctcaagtgatcatccagccttagcttcctgagtagctaggactacaagtgtgcaccaccacactctactaacttttgtatttttgtacagacaggatctcattatgttacctaggctgggagaactgcattttttaagtaaaaataaaagtaagaatagtcagtaattctactgactattccaatattttgaaattgcaatattttcaaaattccagtattttcaaaactaaaaatattcagataaagataaaaggtcagtggaaatgtgtctcttttgagcttggttcttttaaattacatctcatttagcaaattaatgagtacacggaaaggatagcatacctctgctattatgacttatttccttttggctgtggtcagaataatattgtattgaacatgatggtaattaggcaaatagtatttgtcacaattgatgtattttatactattgctattttattaatattttgattcatactacatttaactttttgattgccctaactgaaaaatcattatacaaaagcaaataaaatcactttctgagctcaaaggcttaccactctgggagataaaatatctgttagccgtatgacataattactattcttttctttagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaaggtattgcgattgcctgaatttgagtgggaattaatttgtatcaggactgtttttattgtaggcattgctttgtaacatcttgcttgtctgtttaatacataaatgctgatatgtgtctcctctgtctgggaagatacatgtctcctccctctccagtgaagatattcctgaggtgcatttctactttaactggaggaagaaagagaggggaaaaaaactgtcccagttcatggccatataaaaataaattgtggtttgtaaaataaagaatttgatgacatttaataattattttaagacgggttttaacaccttataatttgtttcttcaagatgattaaatgtaagtacatgaaaataacttttttttttcttttttcttgagacagagttttgctcttgttgcccaggctggagggcaatggcacgatgtcagctcgctgcaacctccgcctcccgggttcaaatgattctcctgtctcagccccccgagtagctggaattacaggagcatgccaccatacacggctaatttttgtatttttagtagagactgggtttcatcatattggtcaggctggtctcgatctcctgacctcaggtgatccacctgcctcggcctcccaaagtgctgtgattatagacgtgagtcaccgtgcccagccaaaaataatttctttttttttttatttttgagatggagtcttgctctatcatgcaggctggagtgctgcagtgtgatctcagctcactgcaacctctgcctccagggttcaagcgattctccttcctcagcctcccgagtagctgggactacaggcagctgccaccacgcccggctgattttttgtatttttagtagagacggggtttcacagtgttagccaggatgatctcgatctcctgacctcatgatcctcccacctcggcctcccaaagtgctgcgattacaggcgtgagccaccgcgcccggccaataacttcattttatctcaacattttccatgtcaacatatctgtacccttccctgcctcagtcagctatggctggtttagcaaggtttctgacgctgctcagagctcttttcttttatcatcagatcagtgatttacccttgatttgctataaaccattccctgccactaacatccaaggaaaacagactgacctgaaaaaccaccttcaactcaacattttgctattgggtccatcagaataaatatatgttttttcaaatttatttctcatgtgaacaaaataaaatacaaggtgtattacaaagaattagggaagaggacttaacaaaatatcaattcacagttaggagggttttctttaaaaaatgaaaatatttatatttatttacacttttgagttcaatttgtgtgaaaaatctttttaaaaagaacatattttatgtctcttacctcattaccagaactgtttatatagttttaagtagaaaattggtttctttgctcccaaacatcagaatctgcacacttaggggtatttactaaaatgtacaattttaaaaattatacaatttagcaatcagagtatcctatgcctttgagatgggatccgtcacgtttaggaatagttgaaaacagtacttttgagcctttgccacatcataatttagtttcttaacaagaattcactaaaatgcattttaccatgacagtacttattctatgatagccccccacgcccccaacaaaatcatgcaggcaagtaaacaaaacaattcctcatataattgtgagaatgtacactgatcattgcccactctgacaactcctgttctccccggcatcctaaggcacatgaataaatgggccaacgaatgaatgaagtatgaagggccttacaggttgcatgaagaaagaacttccttaatttttgtttgggtaaccggtatggccatctaactggaggctgtagttcctgaggttttaaaagctctccagtggagtctgtgaaaaataaaaatcacaggaaagagaataggaatgatgccattgcatgcagcctggagcagtgatgccattgcatgcagcccacgacagtgatgtcattgcatgtagcctggaaaaatgatgccatttcttccagcctggagcagtgatgccattgcatccagcctagggcagtgatgctattgtatccagcctggagcagtgatgtcattgcatgcagcctagggcagtgatgtcattgcatctagcctggagaaatgatgccattgcatccagcctcaagcagtgatgccattgcatccagcctagggcagtgattgcatctaagcctggtgcagtgatgtcattgtattgcatgcagcccagagcaagtgctggtgtggatagcaaagcaggtgacagatccagttcttaggcatgatgggaaatagaaggaacaccaggcagtcgtgctgtgcaacaattcacaaatcctggctgaggcaatccacctggcctctgatgcaggaaagctcaaaggtatgcataagtggaacggacacggacaacacaaaatacaccctgttatgaagtcatctagttagaagcctggcaaattgtaagcaaaaaatgtgccagtgatttatcacggaacatcctgaagtgacaagtcagtaatggaactaaaagattagatgcagtccattgggaaaaaatcctgccatcagaaatcaaaattagtggcataaagaagaaagttgtgtaggtgatatttaatcaaacaggaaactagactaaaagagatttataacaaaaaaatgatcaaaaaggacacaagagcaacagacatacattaatagatgtgtactgggaaattttttattttcaataggggaaaatattgtgaacaagtccatgcttctattcactagatcctcagtacattgtgttgaatgattaaataaaatatcagaaaaactgagcaactttcatagtacttacaggtttacttatttgatctgtatttgcttaaaataatgttctatattctatatgggatttaatgcagttacaaagaattatcaacatgtcagctaccattttaaacatccaaacagcttttcaacaaagcaattagagagcactggtttgaaggcacaaaacaagaaatgtatataaaatatatatgtatcatttaatctcaaattcttaaatgagaaaacttatatatataatatatattaatatagatttaatcaaagtatgtaaattatataggaaatatagtttattaaatataatacattattataatagattctttatataatgtatacgatgattaagtcaatgatcaccaaagacatctctgtttggttgatgattacacatggattattaaaaatataattgaaaatattgaataaatacagttaatcaggtctctttttcttcctccagagcttcccaaagtttagcatttttgtttttgctttttcctctcccattatatttatctatttctagcagggtggtagactgcagggttatacactttttcatttagagatattttagatggtctattgaaacagaaaattaaaaatattaaggctaccagaagataactgaaattgactgcagaacaacatgactgaagaaaaaaggttttgtatttttacttgggaagaagaaatacttaatgcagccaaaagtgaatgcctaattgaggggccccagaagtgggcaggtctctgcagggggtctttgtggaagtgacttaactttccttgagttttacattcttatgatcctttcctggcagaggtgtcctggagattagaattaaacaagaaatgcacctagttccatgtctggtacataatgagccctcaataaatttcagcaattattttaactaaggtagaactattggctgttagtacatccagtgcacaatgtttgaccatcatctatcagtcaatgtatttttttcttctaagtttgacgtttactctattaagactaacaacagaaatacggtagtaaaagaatgagaacaagcatccatcttcatcttctaagtctgtctgttgttattcgtataagaaagtgctcttaactttcaggaattaaactgtttcattttgagaagccaaattctccagtcttttctgaaaggtgtggaatgattttatgttaatatgtttgatgtacaaaagttagaaaatgaacctcaatttttccagagtcaatttttctttgattcagtcctaaaatctgtagccaaaaatggataaatatataaaaacgtagtactgtattttttatgtagatgaaggtaattttatatcaattctgtagcaaaatgtggtttttaaaatggaaatataattttattaaaaaggaattttcttattttaattaatagtttcacttggtcaatagccaatcaataaatattctttgagcatttcttacttatttaggacattgttctaggccctaaataacacaattaaagaaccaacccaacaaacaaaaacacaaacaagaataagatccctgctctcatgcagtttacattcatttcttccacagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatggtgagtgcacgcttgggtattttctagaaatacaactttcctttaaaatgcagcatctcattgaagaaatggtttcacatttcaacacgtattcctctcatcggtggtgaggattgcttagagagctagtgtggaacgaatatcagtcattcattgatcatttaatgcagctagtgtgttagccattctcataggtttctgggaggagcaatatttttccttcgctcgtacagttttacatttttcacttctgtttttgtgtgttctagatctgttctttataagaggtgctaattagccttctctagttacttctctctctctctctctccatatataaaatacttacttctagccgggcgtggtagctcatgcctgtaatcccagcacttcaagaggctgaggcgagtggatcgcgaggttaggagttcgagaccagcctggccaagatggtgaaaccctgtctccgctaaaaatacaaaaattaactgggtgtggtggtgcgtgcctgtgatcccagctactcagtagggtgaggcaggagaatcgcttgaacctgggcagtgagctgagattgtgccactgcactccagcctgggtgacagagcaagactccatctcatatatatatatatatatgtgtatgtatatacacacacacacatacacagacacacatatatatatatgagatggagtctcatacatatatatacatacacacacacatatatatacatacacacacatatatttttacatatatacatatatattttaatgtacatatatttttatatatatacatacacacacacatatatatttacacctatttatctgtatatatatagagagaaaaaactaatatgtatatatttaaatggatatgtcatttccccccaaaacagcaatagtttgtaattccttaggaatgaaattagtaaaatcgttgaatcagctttcaaggacagacaaaactaacctacagtgatgaagtcagacagcagctgccctgtgggtgtgaactgggaagagtgggagggtagacttcctggctgctggccagggtgcatatcttcacctaggtggtggtttcatgggggtctctataggcaaacactcctcaggctgtggacccttgacttgtaccttttacattttcatggtatatatttaaaaaagaagaagaatgaggtagaacttcatggcttgttgcagagacattcatttctagggttattttaagatgagctcaaagaccagtttcgtttgataaattatgaaacaaatgtgtttttcttaagacagcctaacaatgctactggcagcttcaggccaaataaacattttaaatattactgtataagagactgggcgcgtggctcacacctgtaatcccagcaatttgggaggctgacgtgggtggatcacctgaggtcaggagttcgagaccatggctaacatggagaaaccccctttctactaaaaatacaaaaaattagctgggcgtggtggtgcacacctgtaatcccagctacttgggaggctgaggcaggagaatcgcttgaacccgggaggcagaggttgtggaagctgagattgtgccattacactccagcttgggcaacaagagtgaaactctctctcaaaaaaaaaaaaaaagtatataagaaactaaaatcaaacaagcaaaacaaaataaaacaaaacctacttccctggcgtgttctgctatttctatgtttctaagtccattctcttatgatcctgaaaccttttaagttaaagaagtgtagctgtctggacccagcagtagagactggcacagagtaagaacttaggccaggtgtagtggctcacacctgtaatcccaacactatgggaggccaaggctagtggatcccttgagctcaggagtttgagaccagcctgagcaacatgacaaaaccccatctctaccaaaaacacaatacaaaacttagctggatgtggtggctcatgcctgtagtcccagctgcttgggaggatgaggtaggaggatcgctggagcctggtaggtgaaggtttcagtgagccgagattgctccactgcactatagcctgggcaacagatcgacagaggaagaacgttattttttgtgttttaaaatcgtgatcataggccaggttatgcatcagtcctttctagtcatgtttaattaaaaattctgatagtgtagtcattgtgttacttgctttgggagacttttgtgaatgggaagttatagagtgtttcttttttaagtttattaaaaactaaaataagaagcatatgggagcttcaaatagaactcagcgtgctcatgggtgagggaggcagtgagccagagtggctttgaggtaaagagagcctttgatctagcattacaggtcaagaccaaggtctccctggtgcctgcacagcccccaaaacaggacggagacaaacgaagaagtgggtgtcacttggtgaggtgggcacgaggcagctggaagtctctgcccagcacccacccttccctgtcctggcccagggtgggccacacctccaccccctcttgtcttgccaccagcctgggtgcccctcatatcctgagcggcctgggcagtgcatgccagtggttctgggtgcttgccctgtgctcttgaggttggccaggagctgcctgtgagctgctgtccaaggtcttgaggatcctcccttctggacgaggcatggccagtgcgggcagggccgggcttgtgagccaacggcagcactgaaaggtgcgccctgcagagtgaccagatctcgcctcacctcctcccgtctgtgtcactccagacaagactcgcagggctgagagcgatgacagtctctaggtcacaagtgttaggaggataaattccacaggcataaggctccccaaaactagtaaatcttaattctgtatgtaactggtttccaaaaccattttgatgtaacaaagggcaatgacctcaaacccttttgatctgacatccaatcaatataactattgagcatgcaacctcgatctctgccacgcattacaggtactgaccatctcagcagctgttatagaccacacaattactacatgaacacagacatttacaaagatggaattttagaccagacaaagctgctcatgcctgtaatctcagcactttgagagactaaggcaggaggatcgcttgaggaccagaattcaagactagtctggacaacatagcaagaccccacctctacaaaaaaaattaaaattagctgtgtggggtggtgcacacctggggtcccagctactcgggaggctgtagtgggagtatcacttgagctctgaaggttgaggctgcagtgagccgtgactggatcactgcactccagcctgggcaacagggcaataccttatctcaagaaaacaaaagatgtaattttgggtaaaaattctaattttctttcttgtatcccagaaaatgatttttgcatcccctggtgtatttttcccccacttcagatatctttagcaattatatagagtctagtgtgagggagataaaagtaggtagcaaaattgaggaaaggtcatgaattctgtacttttgttaactaataatacaaaaggcatttaatttatattaaattcaattacagttgaatttgtggggagtgataaaactttagccatagaaaaagcatgggtaaagtattagccataggaaaaataccttttctgtggctaaagaaaaagtatatatgtatacactttatatatatatagtgtatatacatatataggtgtgtatatatatgtataattatatataaagtgtatatacactttatatatatattcctgtctatatatttatacacacacctatatattaatttatacacatatgtataggaattatacatatatacacacgtatatatgtatatatattcacatatattcctatatataggatatatacatatatacatattcctatatatgtatattcctatatatatataggtcatatatatgtatattcctatatatatataggtcatatatataaaaccaaatttttaattagagactgtttcagtttccatgtctgaagatctgtggagtgaggcacaatttattttactagtcatcaaagagcacagcgcatgaaacactgatttccccaaatggaggattccatttacatgcaaataaagctttatgttataaatctggaaagcagagatggtctctcctgtagtgcatcttggatccctcatggagagcagcacatttgtgcatgaaccagcgcctgtgatttattcagatcaacagttaacctcggggccttttgctccactgtaaatcttttgatagttcctgcatcatgggatgcagttggtgcattttggggcagtttgttttagatgcgtggggtaatgtttttcctggttattcgtctattacctacaaattttgcttattgaagttttttgtagaattgtaactgaaattgaagcaaagttgagcccctttcatgggtcacaatgacttctgtttgctagttttgtttactcaatttggttctatgtggttgcttttatgtacgagatgtatatattctaattagccaaatggataagcaagcttcttgttaccattagcaatgaatgcttttgtatgtctttattcatttaggaaataatctgtttaatatgttaattaccaaataacaaacatttatttatttttcttttgttgttgcattaaaataaaataacttctaaggtgagaagcaccaggcctgtttcttagattagcacagtaatgcagacataacaattattaagaattaaatagccgagtgcagtggctcacacctgtaattccagcactttgggaggccgaggcaggcggatcacaaggtcaggagatcaataacatcctggctaacatggtgaaaccccgtttccactaaaaaattacaaaaaaattagccgggcatggtggcaggtgcctgtagtcccagctactcgggaggctgaggcaggagaatggcatgaacccgggagatggaacttgcagtgagccgagatcacgccactgtactccagcctgggccacagagcaagactctgtctcaaaaataaataaatataaataaataaataaataaataaataaacaaacaaacaaataaataaaaattctatccatatttttctaacacaaatgttgttcatgtatgaaacgtatcattgtagttctggtgcttagcattttgatctgaggaagaacggacaggcacaagcactatttatcaaggtagtaaaagacaaaagttctgagtcagttttcctgaatttcatctttgacttttcaaaaatgtcctctactatcataaggcaatgctcttttattctatgcttgcacaaagtgtttctttgtagttatactttgaaacatgtattagagttctctagagggacagaactaatggaatagttacatatataaaggggagtttattaagcattaactcacatgatcacaaattcccacaatatgctgtctgcaggctgaggaacaagaagagccattccgagtcccaaaactgaagaacttggagtttgacgttcaggggcaagaagcatccagcacaggagaaagatgtaggctgggagactaggccagtctctcatttcacatttttctgcctgcttatattctagccatgctgcagtttattagatggtgcccacccaaattaagggtgggtctgccttccccagcccactgactcaaatattaatctccttgggcaacaccctcacagacatacccaggatcaatactttctatccttcaatccaatcaagatgacattcagtattaacaatcacaaaacatatggccgggcgtggtggctcagccctgtaatcccagcaccttgggaggccgaggtaggtggatcacgaggtcaacagatccagaccatcctagccaacatggtgaaatcccatctctactaaaaatacaaaaattagctgtgtgtggtggtgtgcacctgtagtccctgctgctcgggaggttgaggcaggagaatcacttgaacctggggggcagaggttgcagtgagctgacatcacaccactgcactccagcctggtgacagagcgatcagaagatgttcttgaaaagaattactttaccatcgctaataatttgggaatcaaaattttggcccagtgatgacgtttccactttttatttatacttcttgtctaaaatttaaaactaattgttttatggaaaaagatcatttgcaaaatgatatgtttgaattgtatgtgactgagcgcaaataaaatatattttcaatctttatttgtgctaagttttttaaaaacttgaacttgaagcttttgaggaaaaggaaagataggtctgacataacctggttgacttcacatggttaaggtggagagaaatatctgagggatatatctgcgttggtagagtgagtgatgccagcattctattggaaaccttcagttttgaagttgagcttatagaaatatcctccatctaaaagtgaaaataaaatgtttctatttaaaatcataaaaacctaaatagaagtgttttagagaagtgttttagagtgataacatgattttgaattaagacactagcatgaaggctgagcttatttaagtaaaatctctgcttaaatttctgtcagctttgatgaacagatcaaagctgacagatgtctgagctgttttcctttgacttttagaatacaacttaagtttttcaagcgattgtaatgcagggattcaggaaatttcttgactaatcattaacaagttgccttatccttagcattaccatattctaaggagcttaattcatcatggaaaatgttctgtccatcaattaatatttaacataatgctaattaacattcaaagaattaaacatgttatctctaacttctttattctttgaggcttgaaaattgccattgtggccggactcagtggctcacgtttgtaatcccagcactttgggaggctgagccatgcggatcatgaggtcaggagttcgagaccagcctgaccaacatcatatttattaaagatgaaaaaaaaaaaaatcagccaggtgtgttggcgggcgccgagtaattgcagctactcgggaggctgaggcaagagaatcgtttgaacccgggtggcggaggttgcagtgagctgagatcatgccattgtactccagcctgggtgacagggcaagacaccatctcaaaaaaaaaaaaagaaaatgaaaaaaaaaaaagaaaatggccatatcaagaagaaatgagctgtagaaatataatctttctgaaatactgaagctaattctgaattcaaatcagtggcggtatatccaagataggaagtgcagtcaggccacagccagcatggtaagggtgcaacaggctgtcctgagtggctcccacgctggtcattgccctatgttaaacagatgaggggagctgacttggccccttctcatgtagaaatataatgaaatagagtactggcaatctaaagactggatatcaaatggctgggatttaattggaggtctcttccatgatgctttaaaaagtgcattgaacatctgtgtacagtgtttttcattttctcagcaaaagtgaagccaaagtaaataagataactgggggaaaattaagacatacccacacattcacacagacataaccccccacacacacatatacacacacacacagacatacccccacacacatacacccacacacacacagacataaccccacacacacatacacacacatacagacatacgccccccacacatacacacacacacacatacacacacagacataacctcccacacacacatacatacacacgcagacatacaccacacacacatacacccacacacacatacacgcacagacataacccccccacacacacatacacacacacatacacccacacacacacatacacacacagacataaccccccacacacacatacacacacacagacatacccccaatacacacatacacacacaccccaaacacacatacacacataccacacacacagatacacacacaccccacacacacacatacacacagagacatacccccccacacatacataccccccacacacatacacacacacacagacacacacacctctctatattttgtaagccctaactttctaatgatggattcttttagttttaaattgaactcataggaagagaccccaaaagcattagtaattatgcatgttgcttttactgaaactataagatgaaacgttaaaacaaagaaaatcccctaaaaaacaaaacatttttcctttgattcccatattaatataaaagtgatagaaaactgaaataatctttgtatctcttaagttaatatgaggattgacttcgaacagacaactccgcgagactttctaaaataatttaatcatttgtctttatagaacctattttattattattatagatgtttcccttattattttaatacatctgagacaaatgtcttgaaaataatattaggtttttctcctaagttggattacttcttccctggtaaatctttgtctttctatgactttgatagcaatgcaaaacaagattttaacttcttattttgtcaagttttcaataaacgtgctcacgtgtttgatgtgtttcagctttggctcacctatcacctgcgctattattgcacagcgactaattctcggttgattttattttcagctccctgtggaggccagtacacgggatcagaaggggtagttttatcaccaaactacccccataattacacagctggtcaaatatgcctctattccatcacggtaccaaaggaattcggtaaggatgtccttgtatttttaattcattgtcatatttcctttcagtgttaatttttctgtcatttgataaacaagtatgctagagcttagtgaaatatttcatataaaagcaaatgagttgcatttaagtagcaggccttccaaacatatcctgcacaatgtccattacagtccttttaccaatgtgatattaatgctcacagtcccctctagggttatgatccgaaataatcagagagaattaatttggctttcttcttaggtttcccaaacatagttctttcagttggttgtttttatgagcaacggaggatttctcataaagtagtgggtgggtcagaactctgtgtatatgtctgtgcatgaatggcacatacattcagtgaactcagtaaccagatcatgatcgaaatcactgcatccttgagtcaacctgtaagtgctgagggacggagaagcaggcagagtcttgactgtttcacctgctgaaccctgacttcctgtttccctcctaaacattgcttccaattccagctaattttccaaaatgacttcatttccagaagggccttccctggtcgctctgcacttcatttatgcaatgctcactctcactcttgaccaggacaatttatcttggatcagattcttttctggagtaaaccagatagtagctgtcatcatcttaaagactatgtccctctttccaataggaaaattgaaaacgctacatagtcaaggtttttatttatgtctgagacagcactcactctgcatataaagcaggtaaaaattctaatgttagacgtatttgagataaagcatttttaacatgtgacaagaaagatatttgatgtgtaagaaacttgtgtgtgggagccagtgtttttgtaaacttctattgtgtcatgattcccgggcctcttacgaatgtaatgcacaccctccccaaaccttgctgttccctttgttatgataaatgggcagtaatacttaaaatgggttctggattccaaattttaagttggaccaaattctttaaagtccctcatttaactttagccttaattctgaatttgaatgaaataattttttttttttttacctaaatgctcagcagtattcccctgattatcacaaaaaagtcttctgttcatggaaacatgacaaaatatatttattacaatggaatttagcagccatattctatgattttagttaaatacaaaatattattgtcatcattacacaattaaaaattttcagctaaagaagtcatactcatatcctaaatatcgtttataatttcccaatttgaaaagtttaatcacacaaacgatcacatcctatctggcagaaagcttcagcgtggaataacgtagttacagcgaatctttaatgaaaatgcattctgtctcatcttttactttcttcccccattcgttactctttcctgataaataaactaattaactaaacaattaatctcacagtatttgtaagtacagggatgcaaagatgaaaggaatctggtccatgtccctggcaggcttatggtgaggggtgaggcagatgtgcaatccagacactacggggtgatgtgatccttaccaggtaggaagaggctgctccctgtctgtcaacacaggctgaaaatgcgaagcgatattattaataagacaggtcttcagataacccagtttcctctattctcatccaaaagcatagccaagaattctttctaaaacacaaatctaagcatgttagtatcgtgataaacatccttagtcactcctgttatttatggagcaaagtgtttgttttcagggtggcctttgagatccttgccacaggcctttgcattccaatccccctgtttgttttttatccacggagtgttagctgaagttgactatttgctgcatttgtccccgccaccattttgctttttgtattccgttcgctgatataatttcttatattccattcttccactaatccttcttgctgatagtgccatcccctcaccatgaagcattgacagttcccgcggctgaagccccataaccctttgtttgttcttctcatcacattctcatgatttccggcagcagcgtagatagcagtgaacagcttttctctcttggcaattgagtttgctcactgggactcagtgtgtgtgacgggttagaacccaggtgaaggaggttcctcaaggaagacgttggggccatgtccagaatgagctgggcattctggctcctgacatcttgtactcaaaatccatgtttgtcttggaaattaccaaacacgttagagcatgatagtcctaagaccatgttactatccccttccctccttttttcttagtttctagtatgaggtggatgtcagctaaatatttcttgaaaaagagtagaaattatctgtggatgattcacttttgtgacccaagttttgggcctccagtatgataaaaatctaatgaacttggggaggtggtgggtgggtgaggatggtatgagcaagatctgtagagaaattattaagtcctctccctctctaattcctgaaaaaagtttttagagcatttcatctattgggaaaattcacctagcctacatgccttctttgtgtttttctctgggaaattataaaatcttaaaagacaagttatattagatatgtgtgtatggagttggttacataaatatatgtatgtgtgtctatacacacatgggcacacacactgttacagttagattacttccgtcatactaacaaatattaacagtaattgtttccgttggaattctgacacacacaactagtgcacacacctccatttcttgtttataatggcttagaatgattgtagtgcaaatcttacaataaataagaaaagaattagttgttcattgcttgtaagtatataccaaatcacaggttttcctgcaaatataaaggccctctgtatcgtcaatctgaatacacagcatcagttaaatttgaagtcacaaagcatgtagttatgtttcacttggaggaggtgtgttcacacacctttcataacctgtaggatacatgaaattgtagagtggaaaacagcaagggattcctattatatgccagagaatcacgtgtataagtcagtgtgtatgaatacggcaacgtattaatgtgaatttggcattataataatcttttgtgaggaattttaaattcctcatcaaatcatcatggggtttgatcctttgcttatttttcattgaataaagtgttgctaaatatttgaaaatatagggaagtctttacagatattcttttttttcttgagacagagtctcactctgtcgcccaggctggagtgcagtggtacaatctcagctcattgcaaccttcgccttccaggttcaagccattctcctgcctcagcctcccaaagtactgggattacaggcgtgagccaccacatccagcccatatattcttaatgttgtgtttattaaaacaaaaacattcctcatttaatgttcaaattggaaataaaacagtattttttcttttattaaatgccaaaagtcaagaagcaaagtaaaatagttttgtcaactgaaaacttagaaagcagagaaaataagttaatatttatttttttaccaaattcttaggataatgatccattggggcaattaatagatattcagtgaaatcaaaaatctccattttgttttcttagagcatcttgtgccaacatcccacctcttattttttagtggtctttggacagtttgcctatttccagacagccctgaatgatttggcagaattatttgatggaacccatgcacaggccagacttctcagctcactctcggggtctcactcaggtaagtcttaaagaattttgcccttaatttagttcagacagctagggggattaatttttaacttgtctgtttcttttgctttgttttgatgaatgagaaatgtaatcatttttgaatttgcgtgtgtgcttagaaaaatcttattttagatataagatctcaaaagtgtttttatctcacacataaaatcacgtgcttttatcatcttactaagattgcagaaaatataatatttatctcagtaaaaggtgcaaagatccgaaaaagagggtgggataatcaactatcatctgtgtttaattttgtatcccatgtgtcttaaccttccttctggagataaaaacgattaacatttcggtctaaagcattctaagcctgtaagtcctacatagagagacccattaatagccacacatgtacacgtgttcacatgtatacatgcatacatttatccacacatgcaaatacacatgagcccccataaaacatggaatgttatttcacaacttatttttatcccattcttacccttaaaatcacatacagaagtctgtctctaacaaacacggtatgcacccaatgcccttactctgagttctgaatggtattcagtcggtttaatatagcacaatttaaccccacttttaattgatgacctaccccttatttgtactgatacattttcatcatttactaaatcagtttggtactgggtacatttactaatttgcctagtaaacgatatgcgtcacaagctttgaccaattaatgttcagatttgattatatttccaggttttctctattttattattaactaaaagtcttaagacctatgttttgttattttctaccaaggttcaatgatgtatctaagaatgcatcagaggatacacattaaatatgttgattattagtaacacattgtcctctgaaaaccttatgccaattcacacacctcccaccactgcttgacacagactcttccacattttatatgcacttttatatattttttatttttattttattattattattattatttttttttgagacaaagtctcactcactctcttgcccaggctagagtgcagtggcaccatctcggctcactgcaacctccatctcccaggttcaagcgattctcctgcctcagcctcctgagtggctgggattacaggcatgcaccaccacgcctggctaatttttgtatttttagtagagacgtggtttccccatgttggccaggctggtctcaaactcctggcctcaagtgatccaccagcttcagcctcccaaaatgctgggattacaggtgtgagccacctcacctggcctatatgtgcttttaaaggttaaaaatatacttcagaaggccttttctgaatcttttaatttaaaaaaaatcatctttggattcagttacttttaaaaattttttaagtaaaattattttaattttaactaaaatcagagtaaggtgattctgagcaaatgattcaccctttacttctgtctactctattatataggcctaccattggtgctttcttcaaaagaaatcataagcgaaataatgattacagtatattttaatcaaatgcactgcctattcttgcctaggacagagtttttaatctttataaaaacaacatatttgagttttaaaccataaagtgaaaatgttttaaaagttcaaaaaataaatgtgaaatttcaactttatcaccattttccaaaatactaccgtcccccacggtgctgtgtgttttctgaatctgtctctgttttcgtttctaggggaaacattgcccttggctacgtcaaatcaaattctgctccgattcagtgcaaagagcggtgcctctgcccgcggcttccacttcgtgtatcaaggtaagcgtcactccacatgtctccacatgtcactgtggtctttcctgatgctgcacccacggctagtctcagacaaagcactcaaaacatctcagctgcatttttgtaatatttaaggagctgaaggtgttcatatgtttataataaaattatttaataaaaatattacaattttttgacagttgaaactcatatttctactacaaaaacacaataatatctaatttatcaggcactagaagggaataaatattgatcatattacctttctgtagctcttcacatctcgtaagatgacttcaaatacagtattttatctaattacgtattttgaaatagttgagatcttagtaacaatataggaaatatgtttaaaatgcattatacaatttcacattttattataaaaactaagcttaaatggaaatttaacaaaacaaaacaaaaaacaaaatatcacgcatgcatctcttatcctaactaaatacctattttattttgtttgtgttttattaactttgggtacttttacacctttatacttatcttttaatttaaaccttttaaaaaatatttgagattgctcaaagattctgcaaagtaaagaattttctcctaatttgtttcacttttgttttgcattgaaaaaatgaccacataaactgttcatacactttcagaagcttggattaagtctttgcgtggagcttgtcatgactgtaaaggttgagatctggaagaaatgatcttgttcagagataaactgtgtgttcaaaaataaaaagcaatattttagtttttctaggtctcaattttgctggaggctacagatactaatggccactgttaagtattttcttcagatctggagaaaaattttttcttagcaatggtttctttcctttaataaagattcctccagaaaacattattgatactattacgtattttttaaaaaggtggagtataacagtgttatattatgtatcaatcgtttctaatcatctcaaattgggaaattcatgacttcaaaacagttcagtgtaaaaacccttcagttttcagcaattagatcatttaaagagtaatgggaagagaatgaggatgatgcttaacagttaatcaggagacaaagatctctctgatcctgtgtaagtagccattgaatgaatggagatgctaatgcattaaaaggtgttacattgttataagttacaccttttattaaaatgtaaataattacccagtagtttttaaaaatggactttattagagagtggcctgttgaaacaacccgtctcttactacttctaattttttcaaataaattctatctgactttgcaaaagcagaatcacgtttagaccaaagtatgtgagatgtgtaaagaaactgggctgcctcaacattttttctcctggaaacactaaagtgactgaccttgtctgcctttataaggggctttccttggtttttgataaagattataaaatctatcccatcatcagacaatatattgcatgcaaatatcctggtgtcttatatgcaaatgttgtccttggtaggcatgtattttaaaaattatgcttatttaaagtaatacgttttcatcaaaatgtcaaagatacggaaaagtagaaagaaaagaacatcatttatagaggaaatttatttttcttgtcctcaagagtatatgacgactctaacatcctcaatattttataaatttctaatatacctccttctcttgctttgctcctactagtgtgtttatgcagaaaattgatgtctttttgtcaaaactaagtttttttggaagaactagaatcataaatgcaacttataaattactcaacagcaatggtaaaagttttgcatacacatgaaaagttaaatggaacattgcttcttgaaagacagtagttccattgaagcctaaaaagtatttgaagccgggcacggtggctcaagcctgtaatcccagcactttgggaggccgaggcgggcggatcacgaggtcaggagatcgagaccatcctggctaacatggtgaaaccccgtctctactaaaaatacaaaaattagccgggcgtggtggcgggcacctgtagtcccagctactcgggaggctgaggcaggagaatggcgtgaacccgggaggcggagcttgcagtgagtggagatcgcgccactgcactccagcctgggtgacagagcgagactccgtctcaaaaaaaaaaaaaaaaaaaaattatttgagctatattatagaaaaatattctaaacagtgctttcatacaccattacagcttcattcattcataaacaaattcagcttcaaattgcacacagactttatgtcttccgtggttgtaggatagctaacccttgttaacagacacagttctgttataaagagctgctggggtctacagtgaaaaatgtttgcaacagcatcagtgtgcaaaaaaacgtgtgactccagacatgcacagatcatggtctctagccttctgcttcccaccctccatgtcatcctggttagtaatgtgaagacagaattaatgatgatgttaccatctttctgaacttctgaagcaatgtaagtctagaggctctttaatgcagtattctagttactctatgcaattgctgggtttttgtgtgttttccacacttcttgagagcagaagggtacatttggaaagcatgagagaagaaggtgtgagtgacatcatggggtgccccagagaaggctgtggccagtgacccttcagaaagggataacccttcagcatggatgtatccatggtgagccagcacttgccaggagcttctcttatctttagtttcgtgccgttgaatgaacgggcatggtcattatccactctcccaggaatgaaactctcacaactcactggtctccagtgatggaaggagcagtatggagactgagatgagtgacctgcattaccaacaagtttcagtgattatggagcactgtttgcagctgtggctcaggcatgagtcctgcctgcccaacctttcacccccctctgaatcagcaaccacttcatcagctgtgatataatcaaatagaattgagaagctaaagctatggtgagaagctggcatgaaaagaaatctaattattcccctcctgaagtataagagtatctgtaatggttttgttaccagaaaggggtgcggatccagaccccaagagaggttcttggatctcgcgcaagaaagaatttggggcgagtccatagagtaaagtaaaaacaagtttattaggaaagttaaggaataaagaatggctaatccatagagcagcagcatgggccactcagctgcttctacttgctattatttcttgattatatgctaaatgagggatggattattagtgagttttctgggaaaggggtagacaattcctttaactaggatttctctcctttttagaccctttagggtaacttcctggcattgccatggcatttgtaaactgtcatcgtgctggtgggagtgtcttttagcatgctaatacattataattagtatataatgagcagtgggaatgaccacaggtcactttagtcgccatcttggttttggtggatttgggccggcttctttacggcgtctttttgtcaggaaggtctttgtgatctataccttgtgccgacctcctacctcatcctgtgacttagaacacctgacctcctatgaatttagcctagtaggtctcagcctcattttatacagcccctattgaagatggagtcactctggatcaaacacctctgacagtttaaatattccaagtctgaaccatgactacattttttccctgcattagcaagctttcttgaagacgtgggagatacacaattcttgcttttaaatgttgaatatgttcagccttgtacatttgctttttggcatcaagcagaaagtgttttataccagtttcttagctcccgggaattcctcgagtgttcacagtggaggagactcctgtagcttcccctcttctccctaaattccctggtcttgtaccatcaagcagggactggcaggacctgcattactggccgtggttatacaggtttagggatctttgtcatttcacagaaaatatattacaccgaaaatcaacatattcttagacgcaatgcaaaagccgaacatcacacaaactgtttcttagtaactccagcacagtctgcttcttccaggattagaagaggccattgattctatgccattaagtaattacattgcatttagagactttgctttggcctgtaattcacgtctttcaacattagaatcaatccgcctgaaaacagaggccaagagaggcagagcccacatccttctctttcctgcctgctccgaggctcctgtggatttaagacagggtggtcacagctgcccaccctgccctgtcttctcccgcatccctctgatgtgcatgattgactgtgtctcagtaaaccttcatgttggagagtacctcatccatgctacttttttcaattgtcttatatttatgcctggctgttttcataaaaggcctatttctgtaatttgtttcaacatagaattcaatgctgctttcagttccttccagatcacacagtcacaccaaaatgagtaaactgcaaggatttactgtacattttaaagggaaaaggaaaccatatttctatattgaaccccttccgcagtgcccagcttgtaaatgtctattggccaggactttttcaagtcatgttttccgggtcaccatctctaacctgggttctcctctcccaggctcctcacctgaagcagcacctgcatcccaggctcaggagctcaaggcttcttcttccagggtcttctgctggaaagactcagtctctttagcattcatggaaatatagttaattaggccagtcatggtggctcatgcctataatcctagcactttgggaggccaaggcaggcagattatctgagctcaggagtttgagaccagcgtggctaacatggcgaaatcccatctctactaaaagtacaaaaaaaaaaaaaattattagccaagtgtggtggcatgtgcctgtagtctcagcttcttgagaggctgaggcaggagaattgcttgaacctgggacgtggagattgtagtgagcctagatcacaccactgtactccagcctgggtgacagaatgagtttccacctcaaaaatgaaatgaaataaaataaaataaaataaaataaaataaaataaaataaaataaaataaaatagttaatcagatggtctcctgaaaataaacagacctaaaaacacagaaatatttttttctcagtttgggtaggaaagatgtacattaagaatttctttacttgaggttatttctgggcaggcaaatacatgttttgattgattttcccttggtttcttcttctttttagagggcatgaattatatggcttagttggttttccacatctaaaaactcacatttgtgtcaagagcctataaaaagcatattctttgcaaagaagaataaatgtaaaattttgcttgcaattcagtgatgtatgttttaattcattgactagtaatggcttgtccaacctgattttccaacgatgagagaggaatgattttgagagagaaaatgtccctcagtcactacatcaaaaagaaaactgcttcacttaggtattgcaagtgagtcctacatgcactcagatttattttatgattgttgttgtggttttcacatcaactgtaacagaggtgcagtaaaggagcagcatgtatctgtagcttagagcatttgtggtgttgaagggtgatcatcgaacctgtcacaacatgcttccggcttttcccgacagatgagcacacatttgcgctgcttcccactttcagcacctcaaagccccagaggagagcgttctgcctctgaagaaacacggttgtctggcctgagaagtcaatcattttgttgatcaccctctattccaggctgacctcattcctgctcacttttccactggcccgatttcaatttggcttcacagcagtgtgaaatatttactaaaggatagagaatgatgacgacagacaatagaatttttctctcggatgccgtctgaaatgtccaggtgaagggccagacccagaggacgggcggggaggatgaagttacacagcactgtctgatttccacccacccgcttcccagacgttccgtggagctgtgatgtctcaattccacagcttctccctgcctccctatcctactgtctcaagtccttacaattggtgtcctcactttccaaacttcttcctctaaaaaacatttttcgtcttgttatccagatgcaggtgttattcatttattgtcattttccttgaaaatagaccactctgaaattcatgaagaaagttaatagtgacttgtgtacaaatgacccttggtgctatatttctcctcattttgggaacttggaaagatagtgataccctgtatctctcaaaggtacaaatatgtttgcatagctctcaaatatatttgtatagctcccagatatacaagtgacagatgcaatacctgaagcctcttagataagtgcaacctttgccacgatagcaggtattttgtaagcaatccagtgtaagtagaaaaactggcaatagcgcttcattttgtggaagatccttgagatgactgtggaagcctctatgggatatctttttttttttcttcatgccattattcaactctaataaaatactcaagcatgcaaacatgacacaaataatttcaagaaatattatgttatatggattgagcatccctaatctgaatatccaaaattcaaaatgctccaaatctgctttgttttgagcaccaacatgactccacaaaggaaaaatttcacacctgacctcctgtgatggacaaatcacaatagaaaatgcagtcaacactttgtgtcatgcacaaaattatttaaaatattgtatttgtatttcaaaatataaaatattgtataaaatggctgcccaccaggacttctccgttgtgccaaagtgctgcttctcgtgcctctctccaggctacataaatccatctggctcgtgacctatttaaagggcaacttgttttatgggaaacaattgagtagtagccaaaccatgacaattactgtgtttcataaactaagtcatcatcttaacaaggataaagcacgtgtagaaggtgtatcagactatgtgtataaagcatgtattagacatcattgaatttcatgtttagacttgggtcccatccctaagatatctcattatgtttatgcaaatattccaacacctacaagaattccaaacctgaaacaccaaacgtttcagataagagatccttgacctataatagaatattatcgttattctgtatttcatttttagcttggagaagaatgattctgataaatcattaattattttccacatcagtgctgttagaaaggtagacacttttattaattttgccttctgatagaaaatatctcaacaccaaattgaaacatcgtttaatcaaaataatctgccaatttccgttttcatggaactgcttccccagcagcagttacccaaataatgtctgtcgttggtctgattcaacagaaaataaataaataaaacagattccagtgtgtcagaaaaagccgtgggaagatagaagggttattttaagggaaaattcatatacgagaacattctgctaaaggactgtgcatttaggatgaagaaacacaaggactgaggaggatagaatcccagagacagtacctaaatactgtctttttcactgcagaggacaaaaacaaaataagcaaatttcaaagggcataactattttcagagtttgcctagtgtgatggacctctttgccaattgaagtattttttaatctttatcccacattccttttgataaacaggaatatctcctgtagatggtaatttctgccatacaacctgaatagttatctcacccacacgttgcactgatacttacctgtcagtacccactatccaaagcccatgagatacacacacgtcattccatatccctgggtttttgcttgctgcaacaatgaaggcctcccattttacagaacctaggaaagtctcatcaagagagaactggaggggcttgctattttttcattttttactttatttatttttttctcaatctttcacccaggctggagtgcagtggtgtgatcttggctcactgcaacttatgcctcccagggtgaagcgattatcctgcctcagactcccgagcagctgggattacagacatgtgccaccatgcccggctaatttttgtatttttagtagagacgggggtttcacctgttggccaggctgataaacgaactctcgacctcaagtgatccaccctcctctgcctcccaaagtgctgggattacaggcttgcgccactgcacccggctggggcttgttaggatttgagctcatcctaggtgactttagagaggactaaatgcaacatgatggcacgtggagcaggtgttctcattagaaaaatctaccctcttaactataaacacagtgctgtagagcaggtctccagggcatactcattttatgtaagtgaaactttatagccactcaacagttgcttcccattttcctgttccccagcccccagtaactaccattgtaaatctctctggttctatgagtgccactactttagatctccccatagaagtagaatcataaggtattcgttcttctgtggctgcttatttgcttatttcacttagcacgatgtcctcaaggttcatccgtgttattacaaatagcagaatttcttcttttatctactccacgttttctttatctgttcatctgatgatggacatttaggttgtttgcacatctagactattttgaagaatgctacaatgaatgtgagagtaccgatttttctctgggatcccaatttaaattcctttagataagtatacacgagtgggattgctggatctgatggtagtttaagatttttattacatcacgatggccatattataacaaatccttcatatggtagcttttctcattagactcagaggcctgtgaggacaagtacgcatggttagtcatctcattatcactagcaggatgattaaatgtaatcgcctgaatatcaatccgtcctcataaggcactgagtctttttatgccgttttcctcatctgaagtgaggacactgagatggtcctgagggcgaagtacagttgggaacgtgctcctcaaatcattctctatagcgattgttggaggctttattaacttctctatctgcaccagctctgcgtggtcccagcgcctcaaatcattctctatagcgattgttggagtcgttattaaattctctgtctgcatcagctctccttggtcccatcttaaacccacgttccacgcaacgtcctggcttgctgatggagatacagacggctgtgttctgtactttgcttctagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtgggtgagcagtgtccctaagcggctgcccgccagaactctgtggtggtgccaaagagttacttctcatgtttctatccaggctacgtaaatccatctggctcatgacccatttaaagggcagtttgtttcatgggaagtaattgagttagtagccaaaccctaaaaattattgtgtttcataaaacaactcatcatcttaacaaggataaagcatgtttcccttctccatatttatgaagtaggccatcaactctaaagttatgggtgtggaacataatctcattttgggaaaaaaccattatcatgttgatttgctatattacttgtgtaacgtccttttaataaattggtgctgatgaatctttgaaaattaataggtaaatgcaggctgaataacagtgaccttgttagttatagtttacctgcttcattttgtgtggaaagctccagcgcaatcatgattagcacttgaatcatttgtacattttaagcgcctcttctcttgaatttgctcataaatcccattaatatcatttggagatgcatgtctgcatggagaagagaaaactctgccaaggtccttaaattatagtaggtaaattattctaaacagaattcactttggagatgccatcattggacatcatcccttcttagagaacttggatagatttatttatagactcaagatctataactgagtagcataataggtaataattattttgctaatttaaaagagaatacactgaattttaccttggctaaaagtgccgtttaacgtatcattgttcatgtacattttctcttactgtgtggtcacacagtgaaagaaaactgcatgccaaatcaacactgtcccacagcactttatttcatgacatatggttgtgtcttttagtaccctgcagtggcaatttcactcaacgaagaggtacaatcctgtcccccggctaccctgagccatacggaaacaacttgaactgtatatggaagatcatagttacggagggctcgggaattcaggtgagtccttgaagtccacagtctacaacagggctcagctggggtccatgggcttctttctttcattcttttgttctatgtttctttccatctctctctctctccctctctcttttttccttttatactggttattttaaatacatagactatactctgtttcccttttcttagtatttcaacaaaatatttctaaccatttttctatattttgaataaatataatcaattttttaaaataaaaactatcaaaagtaccatttgtagaaattgttctttcagccgtgtgcattggctcatgcatgtagtcccagcactttgggaagccaagacaggaagatcacttgatgtcaggagttcaagactagcctggccaacatggtgaaaccctgtctctactaaaaatataaaaactagccaggcatggtagtatacgcctgtaatcctagctgctagggaggctgaggcaggggaattgcttgaacctgggaggcggaggttgcagtgagccaagattgcaccattgcactcaagcctgggtgacagaggaagactccatctcaaaaaaaaaaaaaaaaaaaagaaaggaaaagaaaaagaaaaataaattgttctttcatggtttgttttgttttttttaaattttgccatgtatatatagatagatagacatgtagatgattttcatgattaaggtatatatatataatattatggcattggaggcattattaaggtgtatatgtatatatatatggcattggaggcattattaaggtgtatatgtatatatatatacatatacatatgtatatatatatacatatacaccttaatcatgaaaaaccccaaaaccccatctaattagactaattgtgttaagccaaaaataaatattaacttaatgtcatggtttggtagatccaagtgatcagttttgccacggagcagaactgggactcccttgagatccacgatggtggggatgtgaccgcacccagactgggaagcttctcaggtaagatggagtcaatttcctcacctgtgtgactcaaaatctgcaaacaccaagaaaacaacataaataacagcaaacactccacatagaaattttcctacacaattcttctatctccataatggttgctctagtgctgaaagtcttagagtaagaccatcaagaaacaggtgagtaaaaacaaagctgtgttctccacgaggaggagaccaatctaaaagtgtcagatagcagagctttgacatgcggcaggtctcaggctggcagcagaagccaggaatagtaatgtgaggtagcaaagaggcagaggttaggaaacggttctcaactcttaaaatgcacagcctgacattaagcaatctgggaaaattacactgagcatgtgggctcagctagtcctgagattctaccctactcatatgtagccaggcacgaaattgtagtccactgcaagtccaccctctcttagtcttccttgcacctccgactctcacgaatgcacccgccttgacgagtctgctctccaaatgccctgcaagtcttcccttcccattgccctcgagcgtcattcaatctcaattttgcttttgtttaacaggatatcctgcctccagatgcatgacaccgctttctttcactttgctttgtaatagcattacactgtaatagcattaggactcaaacttcatgagcagtgatgatgatcagtattgcgattatctccctggtcatcactgtcctcacagttgcccacatttcctgagcctttactttgccagttatgaacttctgttaacatgaatgcttaattttatcttgagtatggccaggtgcagtggctcatgcctgtaagcccggcattacattgggaggctgaggtgggcggatcacctgaggtcagtagttcgagaccagcctggccaacatggcgaaaccctgtctctactaaaattaccaaaagtagccaatatgacagcaccaactaagttctaagggattattgctatctctgttttaccaatgaagaacaaagattagctactagagaattgtccaagatgacagaaaaagtactgttttccatgagtcccttcttgcttgcagtagctgactccttctatcccatttgtctgaattctgtcagttgtttatctctactgcaaagggaggctggaatatatattttttcttaactgtggatattttttccctaaatatttccgttctacttttactcaataggttaaaaaacataaagaaaatagatagcgcacaggccattcacagtgtctgatacaacttccattttatcacttcaaatggttcaaagatcttatctctggttctcagcaaataaaaccatatttttatttgggcatggccatttaaggtgttgggaataaagtgccaatctatcatcttattgttatctgtcattcacaatccatgtttgtctgcctgtgtactatttatacttttaggaacttttatttcaaatagcccattactgtccttaaaagctagaactcaaggcccatctccaccaggaaatccctctttcttcccctgaccacatagctcttccaatagtttagtttagcatgtgatttcttaaagtacctgctagatatcagacactgtgtttgttgttaggaatacaagataaggcctctctcattaaaaacatcatcaacaacaacaacacaagttaaaatctacacagatgccaacacttaatgtaattatataaataatatttggtaaatagacagcattacaggtaggtgatgggtgttacaggagggaaaaaagtcacactttttttttttttaagatgtaagagaaaaaaaagctacctgggaaaaataaattaaaatatcttaacagattagtaaaatatagctagacaaatcagagagagacaggaaatccttcaagtcacgggagccatgcagtctgtgtctgtttctctacactcagatattgaattgtgttgctcatttttaagtaaagtgttcttttagtttgtagagatttaagtttcttcagaatctatattaatctctgagtgtcatgcacaattcctagcacctacctcacagtttatgaattcagttggtaaaacctgcttagaaagtatgtgtcttgccacgttttgtctgaggatcaaatcttatcattcacatatatttggatttatcaactgctgtacagcaacctcatattaagccttccctcgagtaactatcacaagtgaacttagcttcagatgtgtaataatttcatatatcctaatattagaaataggttaatttttcaaaagagagtattaaatattgaattgtttttaacctaatgttctcagtcataaatctgtgacagaacacattttacacacaaatgcaggcattaccagcagaaagcaggagacggcaaaattaagacagctgcatgatggattagccaaagttagcagggaaatgccttactaataatagtgaaaaaaagaagtgaccacattgcctctgtatgcatgaaaaataacaacaatctcctttttattaatttcagtttttggagttagccaggagaaaatttgaaaaaatatgtttgacataaataccactgcaatgcaattctgacgctaatttcctggagttagcacggagttcgtgcacttcatgcttctccacaggactcccctctgacgtcagctgcaagccctcggggcctcccaggccacctgcactctgaccaactggctataaatttagggggtccatggtcccttcagttcttgatagttccctagagtacctcacggaacttgagaaagcaatggacttatacatatgattaagactatattataaaggagacaaaccaggacaaaacagggatgtgacaggaccttgaaaacaaagtggtagcctgatgcacttaggctagattttggagcagggacttgtcaaagagcattctatcaaaggtgtgcacaaaaacatgaaactgctaaaatttaagggtccggataaggttggagaatgagcttatgtgaagtaaggagtcaaggactcaaaagtctgagactattggctatcctgaggcaggaaaggaattcccagccatggtaaagattaaatttccccatctccataggatgagtcctgaaagcacagtatagatcaggaagttgacctaaaattttattaaaagacacgtcgtatgcccatgtatagaaataaaatgtgcaagcattatttaattgtaagcaggttattttgtgtgcagaacaaatgcgtaagaagaaggcaaatatccattctgaagctcagttgatggctatttcattagcccaggcaggagatgaatgtgataagagcagaactgaagacagattaaagctgtcacagtcatattttgcatggcaccgttggtctgctcattgcctttaaggatttgatgaggttcaagtttttgaggctgtgtcctaatcagggaaggttctgctttgcacgaagtcagagaataactagtatgtttggaaaatgagttagtagtttatctggctgataaactcatgtttattgaattgagtgagtggcttagtttgggaaataagtggttatatttgaatgaatagaaataggaaagtcaaagtgaatcaaaggagaaggaacgaacatcccaggcctatgatacagagcctcttgaagcaagaaaaaatgattctgaaaaacaagtaatgataagaagctagaaaagcaagcagcagtcagatcatgcagggtctttgggccaaatcaaggagtgtgaaatttggtcctaagatgatcaggaatctatgagaattttaacatgtctcatcatatatacatttgtaaagtgttttctgactgctgaatggagaatgcattgaattaggaaaagatcaggctcaaaaaaacaagttggaagattattgcactaattctggttaacataaggctgcctgcactggggtgattgttgtgaaaataatatgaattaagtgaaataatttgggaaaatatttagaatgcacgccagttaaggcgtgatgactgattggagggcagtctggggtcatggagaaagaggaagctttgaatgtgatgatgtggatggatgccaatggtattaagaaacagtagagacctactcgatgtttcagggatggatagattaggcgttcagttcgtgacgtcggtggatgccgatggtatcgttaagaaacattagagacctactcgatatttcagggatagatagattaggcgttagagacctactcgatgtttcagggatagatagattaggcgttcagtttgtgacgtggatggatgccgatggtatctttaagaaacgttagagacctactcgatatttcagggatagatagattaggcgttagagacctactcgatgtttcagggatagatagattaggcgttcagttcgtgacgtcggtgggtgccgatggtatcgttaagaaacattagagacctactcgatatttcagggatagatagattaggcgttagagacctactcgatgtttcagggatagatagattaggcgttcagtttgtgacgtggatggatgccgatggtatcgttaagaaacgttagagacctactcgatatttcagggatagatagattaggcgttagagacctactcgatgtttcagggatagatagattaggcgttagagacctactcgatgtttcagggatagatagattaggcgtttagttcgacacacttcatgtttaaaaagcctcttctaggccgggtgcggtggctcatgcctgtaaagccagcactttgggaggctgaggcgggcggatcacgaggtcagttgatcgagaccatcctaactaacacggtgaaaccccttctctactaacaaccccttctctactaacaaccccttctctactaacaatacacacacacacacacacacacacacacacacacacacacacacacacacacacaccttcttataaagagacagccagagtcccccgagaccatcctggctaacacggtgaaaccacttctctaacaatacacacacacacacacacagagcttcttataaagagacagccagagtccttctctactaacaatacacacacatacacacacacacacacacagcttcttatagacagccagagtcccccttctctactaacaatacacacacacacacacacacacacacacacacacacacacacacacacacacacagcttcttataaaaagacagccagagtccttgcctggggttattggtctgatcaaatctcttgggggccgggtgcagtggctcacacctgtaatcccaggactttgggaggccgaggcaagcagatcacttgaggtcaggagttcgagaccagcctggccaacatggtgaaatcccgtctctactaaaaatacaaaacttagcaggacatggtggagcatgcctgtaatctcagctacttgggaagctgaggcaggagaatcccaagattgtgccactgcactccagcctgggtgacagagcgagactccatctaaaaaaataaaatctgttgggggatattggatagtttaagtggtgagctaaggatgatagacaatcttatcttttcaataatgttcatctgtttggaataattatcaacttatttctttgctttgttatttaaattatcatttctccctttatacagcagtacttgaataatttatctacactgtggttatttttacacaatggatagttctttgacatcgagtatgtctacacttccaatttagagaatgtttttactagagtattgaacatacatcaggaaaaaagtgacttaaacttgtctattatttttccatattatgattcattccaccaaaatgtctcaaacttctgagtgatgaacgattttcttttcctcagcacctgccagcatcattacttctttcttaccctggtcctcggtatctgtattgccctttccaatcggttagttactgtgatgtaggctagaacattttaagtaaagaaatcactatgtcaaaatagccctatatattccttttcatgcatctttagttgaaatcatcaacagatccagggggaacattactaagcatgagtcacatagggatcaggaagagcatatatacagggtcaaaagcaacgtcttctgaaggatatgtcagatcactatccacagggtccgactgctccctcaaccctcattactcttggctgttgaacttttctttcctctctgttcatgtcaagtaaaaaaataaatttaagaagcagaagattacatggataaaacaatgcaaaaaaacctcatgctacaataggagtttttgtacaagagaaaggtgtcacatcgacttgagcaggtcagagcagacaatgggtaactttttattgtacctagaaaaatagaatggctgaatacataataaaaccaacactcagattaaatatctggtaatcagacaaactgtagggatttgtaagcctaataagtattctcatatgttttatatttagaaaagtgaatgtatttgtagtgttacaattctatctgcattgtttcttacaggcaccacagtaccggcactgctgaacagtacttccaaccaactctacctgcatttccagtctgacattagtgtggcagctgctggtttccacctggaatacaaaagtaaggtcaactctttctgtatacagcttccactgttatactgagtcatttttttaaagaaaaaataaatcatgctcttattaaacagtgaaatattatttttctaaaactgtgaaagacttgcatgaaatttagtgttatgaaatctggctctacgaaatacataagccagttgcggtgactcatgcctataatcccagcacgttgggaggaagaggtgggcggatcaccagacatcaggtgttcaagaccaggctgtccaacacggagaaaccccgtctctactaaaaaataataataatacaaaaaaaaattagctgggcatggtgacgggcgcctgtaatctcagctacctaagaggctgaggcaggagaatcacctgggaggcagaggttgccatgagccaagattgcaccactgcacaccagcccgggtgacagagcgagatgccgtttcaaaaacaaacaaacaaacaaaagaaatatacattatgagagacaaattaatgggtaaatgtataagttcaaatctcaagtaattagatataactgctataatttcaggttgtttgtattaaaaagcacaaaaatgaaccacttgtaatattactagttttttatgagtaattaaaaaatactcatattagcattccccagaaggtggacaatcctgacttctgcctagattatggtcataagccttttctgtttctagtctcaaaggcagttaaaataagaacgagtagagagctgttgctccggagcctgcatttgtgtgttattcattttaattggaggaaggcatcgcacagtcgactctaaccttttaaagatggatgtgagacagagttaatagtctgataaatggaatgacaaaggtcagattcacagatcttttttggcgtttgattatgcaggtaaaccttgtaaaagcgaaataagaatttccaatgagagtaaggtttattttaggacctgttttcaagcactaaaaatgtttaacgttgatattcatctcctttaataagcagttgcaaataagcaaatacatggataagctttaataagtgatcttttgaattgagataaacagtttgctacgatgtaaatgcatgcatatttttgaaaggccagattgccagctgatgataaatattctaagccaggcacaaaccacagggctgtttcacattctggttaaattttcctgcttattatgggcatttgtctgcaagtttatttcaatttatatgaagaggactacttcagtgacagtataaaatgatactgtggatgttacttatgtaggatgtgtctggaaaatctgctactttgatatactttgtgactctctgtagatagaaaaacataagccttgtttatgatagtatttaaaaattcactaatagttttgggggagttagtattgatgaatgctcttatcattctcaaagttatcctgtagcatctgggtttttattcctttgtcttggaaagaggggctagtgaaataattcatctatgcttattattatatacagtgagatatgcacttacctgggcttcagccccatcaatataattatctacatttctctttattcctagacaatatcattcattaaaaaagagagactaacatatttctcattcagatgaactttgagaatccaagcttttgtttaattatttaatgtattttttaattgggctaaacataatgccacatttttgtttgttattttcttttttaagtggttgttttttatactaacaccattctgatagtttatgccattcagttattaagaggaactcatttctctgttcctattcttcatgccagaatttgaaatatagattataggctgggcgcggtggctcacgcctgtaatcccagcactttgggaggccaaggcgggcagatcacgaggtcaggagatcgagacagtcctggctaacacgttgaaaccccgtatctactaaaaatacaaagaattagccaggcgtggtggcgggcctgtagtcccagctgctcaggaggctgaggcaggagaatggcgtgaacccgggaggcagagcttgcagtgagccaagatcgcgccactgcactccagcctgggtgacagagtgagactccgtctcaaaaaaaaaaaaaaaaagaaatatagattatagaaagtatttgtagaattaaccttactacaattagcgtcaaatggtatcaggactgttgatgtaaatcgccaaaagattttctgatatcttaaatttgttgacatatttttgcatttattttaagatatggactgccaatctacaaatctctaaattcagatttttattttatgtccatgaaataaaaatggaaaaaaaaagtagacgcttactctatgccaggtcttgctctaaacttgttaccgcttgttacttatttgtccttaaaacagccctatatttttgaagtctgctcatttcttccaactgaagaaacagagcatagagcatttttagccttcctgggtcctagccacactgttaataacagatggcatgcagaggcaggcatgaaaagtgcattttattacgaataccatttactgagcaccttgcgaggtatccagactaccctaccaggaaggtgacgtatagatggctgttttacaaacaatgacaccaaaggtcagtgctctctgaaaaatgtctggagaatcaaggagcttgtgagtccatactgaggatcaagtatgcctggttctaaaacctgggccattaaggcttatctacatctacttctatctcaggagttcttttctcatatagaaatgaaaacaaggcccccttaaccatagtacatccaaatggacactggtggaaatttctcaaacaaaaaccaaacacttatatttgaaagatgggctgtaaaatagtaatggtagcaaaagcagttccaagaaagtctggtttaatgtatatgatctacagtctcagggatcttacagaatcctctggtttaatgtatatgacctagattctttgtaatcttacagaatccaagtaaaagctcaaaaagattagcatctttgaattattaatatattctatagccatttagtcttcgttcacgttatttaacttaactggacatgtgagaattaacacaagtgtcactcttgttctgcgttcttttctaaagaaaaccaatgaaaccaagacaaaatacatatccagatatcttagagtgcaactgtgtgaacggtgataatattgatttatcctggaaattacaaagcctgacctcaaggtgtacaggatggatcttactgctggccaacaaggtggcagtgactgttattgaactcagtattgatctggtggaagctggtgggaggaacaacaagattgaacacacgggccccgagactggagtgtttctatttaccccatctgtttttttattatttcttcccacattctctgacagattttggtgtaattaagtatttctattgccccagttatccctactatgggcttattagggaagaatttttaatattgtaatggtctcctagagattgaaacacaccttttatagagcagagcttaccttcaaataatcttatgtcactttatgtataatatgagatcctgaaatgacaggttttgctgcacccctgcagtggtttaagatttgtgtttcctaagagcaaagcttcagggacatgcatggtgtttcacgcccttctcgtcacagagcctctgcactgggggctgggagagctctttctggcctccagctgtgcccctaggctttcttatagccccctgatagaggcctgtgggtggaagggcacactccccatgcgtctgcatccagagtcacacgaggcccaggctccacttgcgacagttggtgtttattaagctgatgattcttttctggtcgcctttccccattgttttgcttcacacgtagcatgcggctctcgtctcttctgggggagtttgtcctttagaaatgaggtcaccaagctgggcatggttgctcatgcttataatccaagcactttgggaggctgtggtgagtggatcgcttgagcccagaagctcaagaccagcctgggcaacatggcaaaacctcatctctataaaaactgcaaaaattagccaggcatggtggcctcacctgtagtcccacctacacaggaggctgaggtgggatgatccgttgagcccaggaggccgaggctacagacagccatgattgcaccactgcactttagcctgggagacagagcaagaccctgtctcaagaaaaaaaaaaagaaagaaaaagaaaaagaaagaaagaaaaggaaatgaggtcaccagggtacctgccacgcagctccctgatgggttcaagaaaagctatcattttatacttcagtatttttacgttgttaaagtgggagggatgttcttttttgcagatctctacatcccaagtggatgggatttttgcattgttctagttcacggggttttacaatgtaaggatctgaaaatttctctagtaggttttaaaattactctagagattttaagggtcttaggggtttgaaaattgccctagttcaaagatagttataccaatactaaaatattttttaggttaactgtggagaagttttttttgaatgcacactttttaatgagatctatctatctgtcccccacataactttaatatagtgatggatttcatcataactgtgaaaacattcagagatgttcacagataaattacagaattaaatttaatgtatattctcattaaagattaattattagcagaatggttccctctaattaagaattgctttccatttagagatggcttacaatagaaagtattttgattttaatatataataatacttgtttaataatcatatttttcactttcaggccttcttcactaaatttgactattattacgattcagcttatacgtatttctgtctttccaagttatttctaatttagcttacttctaacaagacagtgaaacattcaatacctcatctaatgacatctatccaaaattaatatcctaaacctaattggtatgtttgaactcaagcaaaagactgttgcagttatcctagcttctttagtgttaatgtatgccactgagtcaaaatagctccaaagtaattctatgtaaggtttttatttcactgcctttcttaaaaggttactttttctcctaattcacattcactactaggaaacccagtgaagttaacaaaatatatttagaatccataagatataatactaatatattctgcaaagcaaatttaagttactctttcttacatagtagcccagcagtagacatggtccagtgtggaagccatgttcccacgtctgaagctctgctcgtagatacagaagcctatgcagagggaacggggcctcaaacatgaaacccatggcaaaggcaacctcaggaagggagggagggagggaggacaaaaaggaaggaaggaaggaaggcagggagggagagagggagggagggaagaaggaaggaaggaaggaaggaaaaaaggcaggcaggcaggcaggcaggcaggaaggaagggaaaagaaggaaggaaagaaggaagggagggagggaagggagggatgaaagaaaggaaagaaggaagtggaagtagaaaatcctgatagaaaaattgcagtatcacatttacaatatattctgaataacgtaggaggttgaatcagtgatttgtggttatgaggaaaaaagaggtaattggaagaaaacaaatataacaactctttcattatttgaattgacgctatttctttaccaggtgggagtaaaatggagacattgtttctacatttttagtatagttgaatgttcaaagtattacttttctttagtcaaatgattttatcgttataaactaaacataaatattttactgttttacctgatttgattcacacttttatattttgcaattattaacatatgtagataattttgtgatatagtactactattttaaaggcactgagttcaaaacttatacctgattaagtcattcttgcatgtatttatataattggtagttagctatatagtgaaaaaatatgtcatgaacaaataagatctcactcaaaaaatacatagtcaaacatgtaaaaaataagaatatctagattttttaaagtgataaactgccttctctttaagtgtttgatgcaacataaaaaaagtgtgtacaataaaaaaaaatttaatggaaaaaattttaaaggcagcccaaccaaagagaaagctataaatatatcagccacctagatttttaagatagctattattaggctttacatttagctttaaatgttctgacaataaaatcataaaaggaaatggtatttacttacgtaattatctttttgaaaagaaaacagtaattaagagagataagctcttagttctatattctaaaaggtttgtgagaatatagtcttttaaaaatttttctagaaaatatagaagtgatctttatgtctcaatttttatagtttgtttattgtttgttttttgagacagaatctcactctggcccaggctggagtgcagtggcatgatctcagctcacttcagtctcaacctcttgggttcaagcaatcctcccacctcagcctttggagtagctgggactgaaggcaaatgccaccacacccagctaattttttgtattcttaatagatacaggctttcaccatgttgcccaggctagtctccaactcctgagcttaagccatctttgcacctcagcctcccaaagtgctgggattacaggcttgagccactgtgcctggactctgtctcaatttctgatataattttgggaacataatataactaactgaattaatttctgcagttcgctgtgctgatgattacactggtcaatagaatattactgtgaagtcacgtttcttatgaatgtgccattaaaatacttccttaattcttgttttcactgatgtatgagctccatttcatttcctcatctcaaaacaggtacttagaaggaagtatctaaatgaggattaaaattctggaaaatgccttatgtcctttgaaatgaaacatactcaacatttttggcaggacgttgccataattgaatacagataacttggattagcccctataattacaataatccttataagcacattcaaattattaatacatgctttaatggcactttaatattacattaacactactgaggagagttcttaattggaattttggtgaacatgagtaacatcacaggaaacatgataaatagagaaagcagaactccaatatagcgagtgtgtttacagagatttcattctgtgcactgagacgagagcttactacctccaacagaggaaggaccatataaaccagcattcatccaatagtgtaataactaatcttcattgcctcatgttaagacacttactgcatttatttctacattaattactccataagatctttttccacatattcatttcaaaaaattttcctaagacccaccttcaacttcacagtttggccacaaacaatgcattcctgcgtcctattaaaattgctttcattaatatcaatcaaagattattcatgtctctctcatccctactgttctaagtgcaccaaggaccatggaaatatctaaaacaatgtaaattctggcttctgtcttacatcacagagaattccagagcctcgtctgggaatgtgaagtcacttctacaatattactttaggcattcaatatttatttgtgtgttgagtgtaacacaaaaaactaataacagattaaaattttactcctactggtgatattttggcgttttaacaattactcagtgtaagggacaggtgccaaataaattacgtaatcacatggtgcttcagttgacttccttcctaaataaagtgattgaaatcaagttgtcctccacaagtctttggagtttcaagttctaatgtatttgacaaggcaggggtaggggtggacttatcctacaatcacttcttgggacagccacttaggattacctcagttatttcagtggtaggtcctatcagtaacgtcacgtacttccaagctgacctcctgcttattgcttcagaaaatcatcaatcatgagataaatattgccgcttctcactccactgttgttttagaatgttgcccatgtgggaaagggtttcaatggaaactgacaattgccattgggttcaactgcccttgtgcctcatgggagacgatgtttggtttgtttttctttaggaatgaccttcacagagtgcatgtgggccttcctcccacctcccctgagggtgattctttctccattccccttctctgccccccttaagtgtcctgtaggttccctacgtgcaccaccaattatacacactccactcacatgtctcgccctgccctcttgactctgtaagtagagtcacaaccagacaacaagatcaatgtggtctctgctaatttcaaatttaaattcttgaggtgggggcacaattagaaagaaaacacctaaatctggttataggttatgataagcaccttgaagcaaattggcggggttctgagatgcagatgacagcaatgcctcagattaaaagtatccctagaaaaaaaatgagcattagtcagccataaaaacacttaggaaaaaaacgctgtagccaaagcaaaatatcaatacagagaccccaggtggaaaagaacccagcacatttgtgaaacaaaacaaacaaaaatgtagaacaaggaagggctgtgagcagtcagaaaaggaagacaaagaagaaaaggaaagaaggttgaaaaagggggcaagagccacagtgcgcagtacgttgtagcccaggatttattctaagaataattggaagtcattgattttacatggttctgagacaggcaaggagctcgatttactgcataagggaattctcaggattttgtagatcctttagtttttgagtgagtttactttcattaaatataatatcatttaggtaagtctagcctttggaaacagaagcatgctacagaaagggaaaactgttgagtcacagtgggtttctgaacccaaatatagagacacaggatgcaaactatttaacaagtattaaactggcactatctgagcacacttatatcctctattcccaaataatggataaatctaaaggatgatactacaaagcatgtatttcaatagagagctagatatagaagtatattgtctcattgacaagttgtgctcacttgaaaattatgattattctatttttttaaataattcctttggtttcaggatattcttactcactttagaattcatgatgtttttctaccaaatttatgtcttggatgttaaaacttgaaagaattctctgttctacagtaggtcttgcaaatgtttcatggtaagtaactagggaataaagagtctagacatggaataagtaatgactagtggctctgtgacttagccaaccaccaactcatcatttatgaaaacctcagtcctgtcatacttttgatcaaggctctagacacaggggagtggactttagacatgtcagtgggattgagatgggtggtgagtaaagttttgagtgttaaaaagggaaatagtatttgaagtggaaatcaggctgggctgcttggagtccccccactttctgtcaccaggttgtctattctttacttcctgttgaataagtaaaaatgaagtagaagctttctttcccagtgcttctatcacagttcaccaggaagtcatgcgatactttataaaggatctataattggcattcaagcctttttaacactatctgattggggcacttgtttatttctcattttaaaatatctgtttccccaaatcttgtcattctcatgaactataatcataaatttcaagtgatctttctgtccttgacttttttcaacacaacaccatgctcagatttattccaaaatgtcactttgagcagatcattaattatatccggctaaaaatccttcagtggttcaacattgtgtgcccgctttattatggcatttctaaatcatgtggcaactagttcatcacccaagtgtgttgactcgtttcttttcatgtgatgtaattattaggtaataatgtccaatcagtgggaaaatgctttaaagaaatcaggggtagattctgtgaccatatcttgttttcaatagtccattttaaatacaaacttacacagttcactattttaaagtgtgaacaatttttgatcttcacatatttatgaactgctttgtatttcctacagttgtgcatgatccatggattaattaaaaattaaattcacaatggccattcaagatcaatctttaggagctcatgctacagaatgagagagctgtaaacaaaagacttaaaatgcagtatattctgtgctatgggagggtaaagcacacattagaggtgctgttagaaataaagctcgggccgggcacggtggctcacgcctgtaatcccagcactttgggaggccgaggcgggcggatgacaaggtcaggagatcgagaccatcctggctaacacagtgaaaccccgtctctactaaaaatacaaaacaattagccaggtatggtggtaggcgcctgtagtcccagctactcgggaggctgaggcgggagaatggtgtgaacccgggaggcggagcttgcagtgagccaagatcacaccactgcactccagcctgggccacagagcgagactccgtctcaaaaaaaaataaaatacaataaaaagaaataaaactcggagttgtaaagaaaaatgagcactcaaacaggatttctcagcaaagcaaatttacttttgcgcagaagggtgcttctagcagggctggctgccacagcagcgccgcaaaggagagtagaagcttttatgcctaacgcgactcctgcacttgtgtcctttccccattggctggggtcaggccgcacaatttagactcagttggctaaacatttaaactttcttagatgaggtgggcgtgtgatgggagagaggggagaggaggaaggggtcatccacagaggactagagagccagcccattctcacatcaggaaaggaatgtgagctggggctgtggcatgtctgggcatgtagtgacaccagaaagaagaaagtggggggtacttggaattagagaataagaagctgagcatgctatttgaaaagaaaccgtgctatatctcacaggtgccttgttcaacttgtgctatatttctagctctagactcagcgggctcctcagtcctttctattgtgataaaaatataaataacatgacatcatgttaactattgttaagcgtacagttcagtggtattaagtatatgcacattgttttgtagccaatctctacaatgttcacatcttgcaaaactctgcactcattaaacactaattctgtctgtttgctactcctagccctaggcaaccacatttccttttttttttctatgatttcgactactagagatagtttatatgagtggaatcatacaatatttgtcttttttttgatactggcttatttcacttagcagcagaatgtagacttttcactccattgttttctttttcatgtttgatgtagtcacatttgtatatttttgcttttgttacctgtgactgtggtctcctatcaaaaaatcaatgccaaatccaaagtcctgaaacttgtctcctctggtttctcctaggatgtaaacagggctgtactgtttggggtggagtctgtaattcactgagatgcatgattcctgcacatgtgtaatgcagaggctatgtcatttcctggcttatgaccttgaatacattacttaccatctgcccatgaatgaggatactggtccaggttgttggtgggtggtacgtagaccaaaatagtcctgtgaccagagaaattttggaaaccatgtattaaataaacttgatgagagttcatcactgcagagtttctctgcaccagtaaaatgctaatataatttgtgagcccctgagagagagagagagagaacattttacttcccctaaaggtattttgtcacttcccttgtcaccagacatgcactcctttatgctttgaagagactgcaggatgtaacaagtggaaataatagaaatagcatttaagatatgtgtcaaacctgccaacagtttacagatgagacaaaatctttttacctctacaatctaaatttcccagatgataaataaaacagtttcttttcttttcataaggtactatgttattaatggcgttttccatatatatatatatttgtgtgtgtgtgtgtgtgtgtgatgaagacttactgactccttacacactgtgacatagaagtctgggtgcagaggtccacatttatagctgtctataatcatggcatttgacatttacttcctccattgtcaggctcacatgatgtctccttgggtgacttgatttctttcttcccctatgttccagcacattatctcaactttaatgcgatttttcgaattaagagttaacaaaaataacgagcagcacctctgtgttagggtgtgccatacctgtgcgcatctagaaaaagaggaattttcatctgtgtgtcgtgtgccagagaataattatgtagtcaattacaataaacactacagccaacaagttgttgtcttttcaaaattagagaataaccacttacgttccacatagtgttcatggtctacctgggcgttgaatactcaggtgtctgtatgcgcctgtattttgatttcttgaccctgtttcatgctactcctctattaatctcttcacatgggtctgcttccctcactctctgcttatcaacttttttgttttgagctctctagtttgaaatatcttttttttttttttctaattgtgatgtttgaaaaccttacactctgccagtcatgcacagttgaggaaaattgcccaaggtcatttcagttcataatatctacaaaagtcccatttgtcctgttttaagtatttgattaaaattgcatgtttatcatgtgttctaaaatcatttttatctggaagatttaagcaaactattctcagaattttgcctgatggatttagaaaaatggctacaataaattccagggacctgatgaggctgattgttatattctgattcttaatgctcacgttttatgatcagtggtaggtgaagccattaaagtgtttttggtcaaattaggacactcatcttcttaatggctgtgttttagattctttgctttcataggctggattcatggggtttaaaaacttctcttgctacattctacatctaattgcaattttacatagaagcatctttgtaaatgtccaaattttaacattggaattgaacacaaaatgtatcagtggataatattgtataaaacactacagtacataagacccacctcctttcccaatgcctgcgttttgttctttcttgtttaagtgtttttaaatgtgtagattgcacaagaattacctttatgttgtcttcacatttaatcagggcacctgggcattcagagtcatgtattaggttggcacaaaaataattgtggtttttgccattaaaagtgatagccaacctaatagtttgtgaaccaccttttttttttttttttttctttttccaagttggagtcttgctctgtcactcaggctggagtgcagtgtgcgatctcggctcactgcaacctccgcctcctgggttcaagcacttctcctgcctcagcctcccaagtacctgcgattacaggcacatgccaccacgcctggctaatttttgtattcttagtagagacggggtttcaccatgttgaccaggctgctctggaactcttgaccttgtgatccacctgccttggcctcccaaagtgctgggatgacaggcgtgagccactgtgccccgccctgtgaaccaccttttaaagaagcattgcttcaccccatatgatatattatcatttatggtatgaagcatatgtatgctgtgatttgaaagaagtacaaattatttctcttgaaaattttcctaaacaataagacagcttactttttcccagatatctctgcttctggaaaattaatctagaattttcctatcatagttacgttttgtgagttctttttagtctgccttaagaataaataattctttttatttgtatatgtcttcctagatacctatgttttgtgtctatataaatacttataaatgtctatttctataggtttgcccattatttatatgatactgctacccctggcttgacaatatgagagatcactttcaatcaatgcaaacatcgttcttctaaaacacttcaggaaaggcagacttgttgattagcattctctttttattttttattttatttttttgagatggagtctcgctctgttgcccaggctggagtgcagtggtgtgaccttggctcactgcaacctctgcttcccaggttcaagcgattctcctgcctcagcctcccgagtaggtgggactacaggtgcacaccaccacgcccgggtactttttgcatttgtggtcgagacggggtttcagggccatgttggccaggctggtcttgaacacctgacctcaggtgatctgcctgcctcggcctcccaaagtgcctggattacaggcatgagtcaccatgcccagcctaacagacatgatgtgataagaattatcatacataattctttttaaaattctttttttttaaagtacatgattctttttaaaagtctaaaaagagaattatgtatacatgtatagactcaagcttaccttctacacagttcatatttattaccaaacaccaccctgcctacttcctatcatatcatatttgtttcacattttgactaatacagtgaataaatataaatagtctaattttttctgtaccaaaaattcatcaatagacgaccttctgtcccctaaaggtcagaaggttcactgccttgtcttctatgttattgtctacattcccccacctcctttctggcttttctgtttcggagccattctgtagatggttgatttctctctcagaaggtttcaccgcattcccaaaaagctcagagttctcctgtgctccactcttgccctattttaacatccccatcactgtcctgtatgtcaagcctagctgtcttctgcccctgcatctgacacacctttaccaacaaaaaaccaccgttctcccagcactttggggaggctgaggcaggtggatcacgaggtcaggagttcaagaccaccctggctaacatggtgaaaccccgtcttttctaaaaatataaaaaaattagccgggcgtggtggcgggcacctgtagtcccagctactcaggaggctgaggcaggagaatggcatgaacccgggaggtggagcttgaagtgagctgagatcacaccactgcactccagcctgggcgacagagtgagactctgtctcaaaaataaataaaaaaataaataaataaaaaataaaaattaaaaaccactgttctcatgatgacttgaattactcctagtgttgcaagcgaattagtgcatctttatgagagaaatgcaaagtatggaaaatacttgggctctgatcatatcaatcgcttatgcactttgtcactccttttaatatagtagcaggtttaaataatattgataaaaaatattcttacacataccaggtattaatctctttgcattcttagcttctaacatatactgggtgtgtagtgacactggcgaagggagaagaaaagatggttctttttacatttcaaatattgtgctctgcatagaactgcttcctgagtctggccatgttaaacaccggtcaaaatggtatttttgtgtgtttttattttattcatttatttataattaattataaattaattataattccttaaaggccagatataaatgcaatttttttttccccagaggatcaattgaatagaattcaagaaaggagaaaatgacaataaatcaatatgtaataactgcatataaatcaatatataataaaaacacatcatatcttatgggtaaaacatgcaagtttagtaactggcctttaatatgaattgtaatgtttcacttttcatttcaaaatattttgtcttgatatttggaacctgtttttgtaatcgatattcttcgttctgtgtcacctggtgtgtccttgaagtatctcagaatgacgatgacttagtatcaccctaaagtagatttttagtattcccgactgtagttaaaatttacctagtattttaagtatacatttttttcagggggaaataaaaaactcagagatgtatggtagatgaccttgctaatatgtggtaggaaagaaaagatgggatttaaatgtagtaatctatgttctaaagttaaaacaaaagattttagacttacattagtaaaagaagttaaaggcctaagtgattgtatatattttttcatatttagcagttttatcttctatgtaaagccccaatggcttgaaaatctgtggtaggaataaagtatattgctgcttaatgcttatggtacttcatacttctaaaaatgcagccatttaaggaaaaatctatttcaacttagaaaaagttcgtggcactcctcctacctactcattctatacagaatcaatgggttctgtggcctgacattactcaactagtttatgtaccactgctttccattctgacctggattccgtagcatgggattctcaaatgaacaatcacggtactgtaagatgaagacacttctctctctccatttcgccctctcagatttggggaaacactcggcaagctggtgaaggatttgggatggtgttgcctccgactcagcagatctggggtcggcactggtgaacacatctcttacaggctccatcatccaggcagtggaggaagtgtactgttagctcaacacgcatgagagatcaggctcatatacatggacacaccgacctgtgcaactctgcagccaggctgacttcactttgccttttgtttaatatcagacacaaggagcctggctatgagggtctggtggggactggagttagtataatgcgtctggcacagtgacagccatgcagggatgacccagggtttcccttgaccttgctgctgactctgtagcttcgacccacagctgcttcctgagtgggcactgcgtgagtcacactgggtctcgtgcttggtggccgctggttttgaagttcttaatcattttatctttgcacttgtgcttttttttttttttctttttcggaaagtgaagtctggtgagacgtggagcaggcatgaagcagatgaagcagggaaagctgactggcttcagggcagagccccgcgtggggaccggcccatgggcagtgcaggcagctgcgtcctctctgtgcctggggaccactagcatgggactgcccctgagtggacctgttctcctgctgtttttttttttttccttctgattaactaaagtcctactcacctcctccaccccagcttcctttctgagagtcccagtcaattaagtaatctgataagttctctcctgttgttgtgaagtacaagaactaaagtgcgaatccaaggccccataaagaatgtgaagctggcctaccaagagaagcctttctccactatttcttcatgacatgttagaataatggaataaattatttgtattcaacaagcccttagcaccatttcaaatgcattttttaattaaatgaaattaatatatccatcaacatccaatgctgtacactttagatcctcagaacttgctcatctcataatggaaagtttgtaccttttgataaaccaaaatcaatttttgattctacaaaatatggtagctgcatatcttgtttattcttatgataaggatttatacagagaggtttcagtgttttagaattcgtttatctgataccttaggctgagttccagtattatatgatgcctttaaaaaaatctgtgagtgtcttaactgaatgcaattcatctaggaaagtgcaggattacagctttaggttctgtaaatattgtttctgtttaatgaagaacagactgttcatgagatccttttttgttgtctttaagagaaagagagagagagattgaatgtaaaatattttttctcttttttttttttgtagaagaacagaattccaagattcacacataatttttttatataaagactgctaagtatgcttgaaaaacaaaagtaagagggcaatatcctggagttttacatatcataaaaacacaatttttgaagagactttttacaatatgtatatattgaagttgggatcttctatactcaatgtggaagtaacaaattttgttattgaaatcaaagccttgattcattgtgtaatgaaaataagataatttaatttttaacaattaactcatagctctgatttaaaggtactcaaagtcttcttggtagaataacaagagaaagagttgaagtctttgttcatttctacagaaggagagcaatagaaataaactttggttattcaaatgataagaatattgtttacatcatataatttctagcatttgtctttgcatttctagctgtaggtcttgctgcatgccaagaaccagccctccccagcaacagcatcaaaatcggagatcggtacatggtgaacgacgtgctctccttccagtgcgagcccgggtacaccctgcaggtatccttcttctcagtgctcaggaataacatacacatggtcatctttgtgcagctctcttaaagccaaagccctcactttgtacccatgttttcctcactcagtttgtgaatcatactattcatattaaatcatgcatgttggtcatcttcgtcaccatttggaaacagcttttaagtgataatgtactctttcaaagctaagcattgtatttttcacaattgttttatttcaaaatatatgcgttcccaataactatgcacagagcattctaggggcaaaatatcaacactgtctctttgaaagtcctctcctggcagccagtaattgaatctgcttctgtatgtgcacctgctaccctgcaaactgttctcatcattcagtataagtcatcattaatgccctctttgggctaggtagataaggcaccaaaataaaacatttaagtaagttttaaaaactattaagtagaagtttttcaatgaacttttactatcttctatataaagagggtttttttttttttttttttttctgagagggagtctcgctctgtcacccaggctggagtgcagcggcatgatcttgatcttggctcactgcaagctccgcctcccagattcaaacaattctcctgcctcagcctcccaagtagctggtattacaggcacctgccaccacacccggctactttttgtatttttagtagagatggggtttcaccatgttggccaagctggtctcgaactcctgacctcaggtgatccacctgccttggcctcccaaagtgctgggattacaggtgtgagctactgtgtccagccaagagttttttatataaaagttttgatgaatgatttataatctaatgtatggcaagagtagtcatttttctcttattatttattattaatattttctagtttaaccatgagtaagcctactctcagaatagtgtctatcacttagcataattattatataattctctctgccagcaataaaaattgataatcaaaacatgtatattctaaagtcaggagaaatatataggtcgattgacattccagctcttcagttaattcaggtaatagaatattttagctgtatgtttataatgacactgacactgataggttttaaaggaaaattgtttagctatgttcttatatgcagagttgcaacactacagccgtgaaataacagcactgtgtggaattcagtttctgcatgtacattggggtaaatattgtgtagcagtgaatcaagttaagagcaagaacaggggctggcaaacgctgaatgctaaaggggtgcattaccaagtgctttatatacaaaatctcacttctcctgatcaaccgtgggacatgggtaccatgtgatgtatgctttcagcttagagaaaatatctgtgaaataactggcacactttagtataggaaaactattgtagctgttattagaaaccagtatcaatgtataaagccaccttcgtaagaacaaacctaccacttacattataacaccatcttggtgggtaccacaataattgtaactctgcaaaaagattggaggcagagcgagagtctctgtagtggaaactggtgagtaaggactcctgaaagttgggatacctcagtaagtttgtaaccaaacacactcaagctattcaggctgaatctttaggacacaacgttcctgatccacctgatatgtcagaaagaattatcctaggccggttgcagtggctcacacctgtaatcccagcactttgggattccaaagtcagaggattgcttgaatcgaggagtttgagaccagcctgggcaacacagtgagacaccatctctacaaaaaatacaaaaatgagctgggcatggcggcgcattcctttagtcccagttacctgggaggctgaggtgggtggatcgcttgaaacaggaggcggaggttgcagtgagccgagattgcaccactgcactccagcctaggtgacagagcaagaccctatcttaaaaaaagaaaaaaagaaaagaattgtctttcatatctcaaggatctcatttagagggacacctcaatctgtactgacatgctgtttttgtgcctttttcggggcttgctttataattgcctgaaatcaggtaaatatcatgtttcctccattctccctcaaattcccaaactgtaatatttgctcttgctcatcgatgttcctcttctttctacctgatggtgagactttgcagattctgttgccgttcttttataaatgatattatgacagctctcagagaagaaaatagaaataattctttaccaaagaaatttcttataatggattattgaatatgctgcttagggacacaggcctgtggatgcacttctgcacagtcccagcagaccgtttattagctctgtttttcaaatgcaaactaagctgtgtttcttttcttcgttacaaacaatgccaagctttgagtttgcaagctgctgtttgtcattcacatgagcaaaaaaggattctggattttttttgaattgctaacaactgacaattttactaacactttaatatatttggaacaacagatgcatcaattacatattagtcatgaaaagcattgttccttgcatagttcacacgtgagtgtctataaatacatatgcctagtgtgattcaggggctgccatgacatcacacgctgaaagtaaatcctgaatattggaatgatgtatgacttccatcttctctcaacttgttttaatggtctttttaaacataaaaaagaaaattcccattggtgtaaaaactagtaaataaatgcacagggtcctatcttgttttgatttattagaaaacttgtagctagaatcgctcatcggaaacgtttataacaaaatcaatagcagaatattacctagattggtaataaatgaccattttattggtagtctctgatgaaaattttttgagacttttgaactctatgtttttccctatttcagaaggaaatttgtaaggataatttaatgcgtcgaagaatggggatacagagagtgtcaatgccggcagcacaaaattacctggagtatcttctttaaaattaaatatggtcttctttactgtaactacttttaaaaatatcaagaggtatgagaaagttagttttgtggcaggtggattgagtatgaaatgtttgagagcttagggaatcggtttgccattgataactgcattagtgcaaacgcttgtttgatgcgttcccagtgtggctggaattatttaacatacattagatattgtttttcaattgcctctatgccaattgtgggtggcaaatggaaatttatgagataagcaaacctggctgataaggccaccgagtcacgatcaggaaaaatataaaaataggccgcacacagaggtctcatggatcacctctcttttactgagaaagagatgttagcacaaaacatctttgaatttaaccctctactgtttgttttttttttcattgagaaagactggaacagattttttaaagtagaaagtggaaaattcatgtatttacagggtaaagagaccctgagtgatgagggttaatttcattgcaggcaggttgttgtgatgtgtgaggatgtctagtgagaaaatgaatgtgaagtctccgttctgtgataaagaaacgacccagtgctttgctgaaccctggtagtcatgtgacgcggaagcacagacaaccaccgaagctacctctccataagcagactttgtattgctgacattttggccttttaatcaccacctagtactttctaattgttttcagcttcttaggccaaaagctgtaaattctggtgaatgaaaaaaaaaatgcatattttgcccaattcagtactcttaagtatcaagaaaggagctgagtcgaattatggtctggtcaaaaggacattgcaagattttgtttttagtagaaagaaacacggtgaaaatggatacttttctatgttggttcaaaatgtgactcactaataatcattactaaaaacagatttcacaatttttgaattttcaaatatttataattaaaacaagaaaggaaaaaatgcagatattctcaaacatttaatccttaaatactctgtttttagttatatgtattttcttttgttttcttttaaacagggccgttcccacatttcctgtatgccagggaccgttcgccgttggaactatccgtctcccctgtgcattggtaaggatgcaccttctgtaactctgctgctgcgcacacactgggaagaacatgcctgctctactcttggggtcaaagaatgcacttctaaatttcttaatttcaaaacacgtgttatatactaatagcacataatgcagtagagcagaatgatgcgtttaacctgcaccttccccactggatgcagcaactccgtcttctcagtgtgtctgggtcagcccgcacagaccagaggcaagactgcccgctcacggccctgcaccaaaacgacatgtgtgtcagaaggccagtttgttaatttgtggcaaagaaggaatgcagctggtctgaaagtctggggagttttctgtatagacctttagcctcagaaaaaacaagttcccaggaagaaaattcagaatgacagattactgatggagtgatggagtatttcatgttggaaacagcctggtgactatcttgtggatgcgctcctgggggcacaatcagccggcttctttaggaaaaagctttccagagctgtatttaatggcttgagactccctaaactgttagcataggtaatgtgatgggagtttaatgattccaggggcattgaaggtggtggtcacaagtccctcagtacaaaggttggtgatgtcagggtgccctttgctccccatcattcaggcccccagcttcacccatcacctatttgttgtagcccaactcagaaacctttacctgtagctcaggcaaccattcaaccttgcaggtactgtctcagtaggatcatggtcagttacttgacactccttacccgcaacccacaaagtgatcggcttctccaaacctattgttgttctcctggatctacttcctctgcgaatgctattagcagtatcctgcttttttttttttttttttttttgtctaaacaacaaatctgggtattaccttaaatttctccctcactccctaaatccaagtgacttctcactcctgtcaccccttccacctgagcgtatcctcccctgtgattcttagctccaatgccccatctttaagatggcacagtcccctcctaaattatcgtctccatggaatcctaacctacagctcccatattcagccatactccaactttatcacaggaaagaggcaaaaggaaacatcggcagtactgatcttgtctttatttaaaattttcatattttgttcatcatagattttctgcctttctttttattttttccaaatattgcattaaaatatttattggagggtttaggcaccctcttgaattttgcactggagagagtgtcccctcctcaatgctctctgagctcccacctgcaggtgcagtgagtcatctctaccctgggctaccaccaccatgtgcctgactttacttcctgcagagttgtaatgatattgctctttaatttgcccttctacaatccccaaaggctttggtgacagagacttgcaatactcacctctgtatcttcagcacatggtagacactcaagaatttcaattaaagaatggctagggaatgaatgagtatcagagagcctggatcattataacagtcacacttctggggtgctgtctttattgttccccacagtcttcgaacactcaagtattgctgggggtgtgctcagaacccatttatgtccagacagtcagcctcaaacatgccatactgccaaatggtgttttaggagaaagtggtcaactctatatggatgaacattagctattttaaaggccacagaatagccttaaaattgtcctgggagctattcacattctgtttagaattcatttcggcgtagtgtggtgtgggcacccacaagtaaagcgaggtaattactgtctgttacacattcttctgacagcctaatttccccacatctcaaataaatttaggtattcaatggtttttagtaatacacaatttaactgccttgcatgggatgcaggtgaaattgtgtacagaggaaaataaaactgcacgaaacctgtaaaacaaaaaacttcagcctttatgataggctcatccaggagagaacgtctgtttatgttatgttcactacatcatagttgcttacaagtgaaaaatataccttagaggacagtatcttatttttaaaagctatgtcttggtaaaaataaatgtctagattaacatgtcagctaaaaacattgagctacttttacagacgtttaaaatcccagccttgaccgggcgcggtggctcacgcctgtaatcccagcactttgggaggctgaggcgagtggatcacgaagtcaggagatcgagaccatcctggctaacacggtaaaatcccgtctctactaaaaatacaaaaaattagctgggcgtggtggcgaccatctgtagtctcagctactcgggaggctgaggcaggagaatggcgtgaacctgggaggcggagcttgcagtgagccaagatcgcgccactgcactccatcctgggtgacagagcgagattctgtctcaaaaaaaaaaaaaaaaaaaaaaaaaatcccagccttgatttggaaggaaaaaattaaaaaatttaaaaaacgaaacaattaaaactgcctttgattcatacagaacatcaatctgcctatttatttttaaatgaagagccttccctaaaagtcaggaattgaaattttttaaacttcacaatgaaatcaattctaagcagacatagactcaaataatatgcctttgctgtcactttgtattacataatgggatgttttattcaaagaattaacttatatttgcaaaatataataggcttttctcttttacttaacatcgtaaatattagcacatgtttaagttatgtcaacttctgtaattctttacagggtatacaagttttttcattgttttaaaaactcacacatgacccatgataaatctcaaagacagattctagtgattaaaaggttttttgtagctgttagctttagattactccaaactggggaattgtaagaggagaagtccatagagagataatattttacttaagagctcctggaaatcccatgacctaattttgaaaaataaaagtactaatgaagagaatgtatataaaaccacttctctagaggttaatatatcaagcagtgttctcagaatttaaccagtattgactgttttgaatatttataacaagccccagaatggtctcgcagttttctagggctctacagctgggtgaagttcatgtcacagcaggtggcccaggacctccctgtctcactgcaccgcagggctcttcagcatggtgtgtctgtgtccttcagtaaaaattctgtatattctttctcccgccaaaaccaagaattcacacaaaataagatgtataaatccagtaaaatataaggtctctagccattttataaaaataaactcctttccctttacaaaaaccacatttaccaataactctaaatatgctatttacctataagaaagggtctggcatggagggagcttcccaggcaggaggcaggaagtcagtctgcaacttgatgaccacacagagatggacactgaaccaatctaagacatggcaagcccagtcgccttaaaatgtcacaaagggctgggcacagtggctcaggcctgtaatcccctcacttcgggaggccgaggcaggtggatcacctgaggtcaggagttcgagaccagcctgaccaacatggtgaaaccccatctctactaaaaatacaaaaattagccaggcgtagtcgcagttgtgggcgcctgtaatcccagctactcgggaggctgaggcaggagaatcacttgaaccagggaggcggaggttgcagtgagctgagattgcaccactgcagtccagcctgggtgacagggcaagactctgtcttaaaaaaaagttacaaaggaagaaaagatggatatgcgtcttttgggagctctgtttttacgcttatctattgacttgtagttttctagataagcaacatcaaaaacaaaggattaccgtggttttaactaagctctcaagtaattaggtgattgatgcatgtttgacaggagatgaacccagtggtcaggcccatgatcagtttcccatcacacagagagttggtctgtgtgggacacagacatccgtgttgatgatgctgtctacgctgaggtcctgggccagcccctcctgcagggctgcctcagtcctcagctgaagatatgtatgagtgtttgtattttataatttccctctgcatgtgtgtgtgaaaatcatgctaaaatcaaaaggaactttttagtaataccacatttactggttctgttgttttcctttttttgtcattgattcggcctttttcattcgtgtcttccctgtagttgtgttacaggaaaggggttgtgatccacaccccaggagagggttcttggatcttgtgcaagaaagaattcaggacgaatccgtagagtaaagtgaaagcaagtttattaagaaagtaaaggaacaaaagaatggttactccatagacagagcagccccgagggctgctggttgcccatttttatggttgtttcttgatgatatgctaaacaagcggtgggttattcatgcctcccctttttagaccatagagggtaagttcctgacgttgccgtggcatttgtaaactgtcttggtgctggtgggagtgtagcagtgaggacaaccagaggtcacactcatggccatcttggctttggtgggtttagccggtttctttactgcagcctgttttgtcagcaaggtatttgtgacctgtattttgtactgaccttctctctcatcctgtgacttagaaagccttcaccatctgggaatgcagcccagtacgtttcagccttgttttatccagctcctattccaggtggagttgttctggtttaacacctctgacagttggatatacacatctactgtcactgcaggtcccacgagccctaagggaaagggtgttactgctaaatgtatgtaggcatgccactcagatttgctggtgtgtcttccgcacattcagcagctgcatggacaaagtgcacatgggagcctggccttgcaaatgcctagtctctgccacaaagaagtcgccttgagaggttatactttaaatagcaacacagttgatggtgtccaagacttttccagaattatgactcacaccacaaaaatatacttttaaatgtttgtagctcacatttttcaacttatacaatgtttgaaatccagaatatggtgccctggcttgagcaatcaccatattcactagacttaagttttagctatttctcaaattacaaataagttgtttcagtcttgatgatgattaaaaaagaaaaaggcttcaccacaggtcctagggggcctctaaaagagggcttccagaaaatattttgtttaaaacattttgcataatgagagcattgttagaataaagccatttcctttgggcttcctgaaaagaagtggcatcatttgcattaattttggaatataagaaattattttaataggctacaaatgatcaaagattggaacttcaaatgcttcgtcttgtatcactgggcatgtttgttgtaaaatcagttgtgtctctttgtagtcaaacctcagatacagtagcaaaacatgtgagtcgccaagataaggcaagatgcatgaacttatttcaccctctctcacagcataagatttcctggggagaaagtggttgcagttagctgccttccgaaattgaaaagctatctgacagtcatgtgtggtggctgaaacttgggtactggaaccagacgcagctggaatgaccttctggttgtactgtttaccaggcatgtcactttaggcaaatttcttcatctcttccaggcttggtttcttcatgtgtaagaggggaatggtaatcctttcagggttgctatgtgagttaatctatgcaatgtatttatctaggcacagtaagtaccacatagttagcaatcaatcaatagggagtaatactacctctcaatgagtagcagctaatatactgaagtccatttgatgcctgactgtgacgcaaacattacatggactcatctttactgggagcctttgagtgtgagaggagaagatggatcttgaaaaatggtctttattctaaagcagttcactgtcaagagggagagcacagctcataaataactaaggcacacagcattgtatcgtgtgctgtaattaggggcagaattaactccgaagacttgctctttctcagcatagttgagtgaagcaggttggagcaaagattccagggagaaagtgaggacctgcaggactgacatcttgtccacttaacagcaacctgtggagggacgctgagcaccttgggtggtgtgatcctgagccccggcttcccaggttcttaccccaacaacttagactgcacctggaggatctcattacccatcggctatggtaagtgaaaatgttaccaattcctaaaagttcatttttttcatttccatcttggaaagaattaagcagaataaaatgccttattctgttggcataactgtatctgtaattgaaagtggcgtacagatttaaataaagctttggcagagtaactttgagagtggaaaacttatttgaaaaatcaattaagccatgcaactcttttcaaggcaaattaaattggccgaatgatgatatagtaggcatacgaagtacaaaatatagcatccctaattcaattatcaatctctttatttataatagctctttttctaatctatctctggaagtcaataatggttattgtttcttctggataattctgaaggctttttaaaggttatgactccttttaaatataaaacaactttcaagaaatagtattgttttatacatttttgctatatattacattgttttcaggttaataaataagttgtttttttaatatctagttattaacattttaggttattcaccttaaataattcataaatttaattgttgtgtatactattatagaacctttttctggcctctcttcagaaatgcatggtctttgtgaaattttgatcccctctcacgcctttccctgtctgcctcctggtttccttcgtattttagttcatttatttgagtctccctacttgtgattttctctacagcactcactttaggtagaccaagttaggtacttagtgaatgtcctcgggcagagtagctgggtatttctgtactaaatagtagctgaatgatgaatgaatgaatgaatgaatgaatacaaccataaatagaaataactgccctggaagaagatcacacactttattcaaagcttctgcttttagaatctgtgcccaggatggcagtagcagtaggagtgagcagtcagggtggacttgctcagcagagagtggccggggaatgaacagtcggaatgacggcccgacaggtcaatcaggcgctggacgtgggaaatgcagttgaccaacatgactgttccacaagaaaagaggaggactgtggaagagcagctcgatggggacggcctggggagtccgtcacctcccagtgatctgtaggaggccacggtggtggtcaaggaagggagagactctgtggaaggattattataggagcccctgtttctcccgggtttcttggtttgctggttttgtttttttcagtcatactctctctgagcatgaggcagtgattctgccagggctaaatgaaacggagacctgggaatcaccttcagcaacgttgcttccactgttctcccaagctgggcccatcgtccttgccctggagatctggagacatgaacttattgaactaatctttggagtcaggggttaagaattctttcagaggtatgtgtaacccgggatagtttacacagcactagcgctcttaaggaccggagccttgttggtcaaattattatagtcattaacatcagagaatgagagaaatctgaggcaaactgcagctatccctgaaggaggtgtggtttttttaaatgagttaaggcacaggggctccagtttcctcctttctatacctgaaatacccacataaggttatggtgagggttaattataataattctggctattgggaggcgaaggccggtggatcgcaaggtcaggagatcgagatcatcctggccaacatgatgaaacgccgtctctactaaaaatacaaaacttagctgggcatggtggcacttgcttgtaatcccaactacttgggaggctgaggcaagagaatcgcttgaacccgggaggtggaggttgcagtgagccacgatcacgccactgcgctccagcttggtgacagagcgagactctgtctcaataagtaaatgaataaataaacaaaaattctggctagaagattagtgcagggtttggcacgtgataaacaacaacaacaacaacaaaaaagtgaaacaaataggaaagtcacccagttgtattttgtattattcttccaaatgtttgtcaccttcttctcaaaactaactggaaacattgtatttatgaataaaataaaattggtataaatattttcttaacttatttttccaatgttactattttatcatttctgagaagggtatcatttagtatatttctgtatttattttttatttataaactattgtgcgagagaataatttgggaaaaaacttcaatgaaaccaaattgtctaaattcatatttgggatctataaacctaaacaaactatttaaagaaagactgaaatgaaaaataacttatgaaatatctttaaactgatgtaaatcttaaaaaaattggatattgcatagcctgagggtttaaagaggatctagaagaggagaaaagaaactttatctcaaatcaaacaggcatgaaaagtattatccctagctttttagaatagatgtaggtaagcttcagaataatttgttatagattacatttgagtaacgcaccaggtttgcctgtgataaattctataacctctaaacagtaatagatacgaagtgagaaattgggaggagaggcatgtgagtggcgatgtgtcctctaacgtggtcaacatttggaattatgatgcccctggtaggagttctttctagggcttaaatcattttcgagcaatttgcagaatctgagaaaattttactacctagctttcaaccccacattgttttatagtgaaaaacatttaagtaaattagttctatgtattcatggccttctttaatttctgcgtcttctcccttgtaatatccactaccagaacttgaagtctccgttctatgcacatgagttttaaagcagcgtcatgagtcttgttttcaaatgtcaaaccacacttcggccgcatgtgaatgatttcctctgagtcagattctcctgttcaattcctaatttatacccacagcactgcacagctcatttttgtttctctgaaccttgccttattcttgtcagcaagctcttctcagaatctccggaatcataagaaaatatcagatcacacccttggaaattttgaggaagtaagtttggggtttaagctcagacatctgcacttacaaatgaagcactcactccagaagtttttacgtaaaacaaaatgggaatatagcagaggtgaccacaattatcttgtaattatgatttctcccctttttgatctctcatgttgcttcctattaacacccaaaccataaagtgattctggaacatttcctgtggttacaactcagaaaagggtcccctatttcctaatgggacaagcagggagattgagaaggtagacaggtatttcaactgacgtcacacaaaaaatatcttaccaggataatgctgttagggtgatcttggtgatcaggttgcaaaagaatagccagaagatttgtcttccttaatgctgagaaaaggcatatatgtgataggtagttcacgcaagtaaccagttaaccagctcctcctgtaagtgcaaatggtgcattgctatcactactctgcctctcccctcctcggttttcagaggtttgggaaactgtgttaaacaatatttcctttgaagtatcactggaaatttcaacaagaaacagacgttatgggaaacttgattgccttagaccctaagagagtgtcagatttatagtaatttgtgtctacttaaacttgcaacactaagtaacaaggaaaatgactgccccccagggtgctcaaattttactgtgtgcaggaagcctcaatggcggttgtgctgttacaatgtagcttcccgtggtctctttcctaaattctgactcagtgccccagctgaagtaggaaatgaatttggcatcttcccgaagcagctccagttccttggatgctggagtcagactccttcaggaagcgtttctccaatttatagaagagcactttcaatctaaataagatgagaaatgcacaaaggttttcacaagattcttacaaatattacttatttaagaaaagttgctttcgtgtaaaaatgtagaaatcatgagattttgggaagttgaaaatagagatagaagattattgagtatgaaacaaacagcatgacaaatcaaaactccaaagtgaattacaaaagaaaaaagaaaaaatcgttcttgcaaaacattcttaaatgtaatttctaggcttcagattgtatctctagtatctgaacatacatatctgtttccttgattgacagttttgggatttggattctcagggcacagctgtcctaccagtaagcgttgctcctccagttactctgagtaataacacttatccggaatataagacgttattgccccttcttgaagaaaaatatatgggatgtttttcaccttgggaggattttattgggtattatgaatcttcccatacaactggataagcatgggattgcctgatcgattgtctaatccaggagttaagcagttgccagtttagtcaaataattattttgattaactctactcccagagcccattcccatggatcgagccacaatttaaataagcaaaagcgattaactggtttggcatcatgtggaaatcatcttacctggctttcctaattactcattccagaaacagctgttttctataccctgcctcagtaaccgacagtgacctactgcgggacagtgacccacacagcctgtccctcaaaatgaccaagggaactctagccaaaagaactgaggcagttggcagcataagctgtggttgctcacaattttaggctctgagtttagctgagtagaaatcttagtcctaccaatgattgcacaagatactcaaatgtttttgaaacttgtttccttatttttaaagggaatataatatatcagtcccatagggctattttgaagtattgtaaatgcatgaaatagggtattatttaagtgctgtttttaatagttaaaccaaattctagtttacttatctagtagctaaacctgatagttgtgtgccattttctttccttttcacagacttggcttgttgttttgtgatgctctggcagagctcaaccaactcaggatttcggtctccgttttcttgagagtgtctaagggcacagttaacagaaatgcaatgaagctttctgtctgccttaccccattatcttttatacttaaaatctactgcactaatagtgcacacaatgctctccaaaattaccatgccatcagactttctagaaacatagggacaatataaaaggttctttagaatgttcaataaattccataggtattaacacttttgctatattttattacacacagaaggtgcaaaacagaggaagtaatattcacaggttctatcaactaaaaactagggtttaactctgagatcatggtcacattactattcaaagttttgtcaatgccaaaggcaaaaattctctgtgcaggtgacttgtcactggcacttaattttcaatatgtaatcccaatgggataagacagtgctgggtaagttccaccaaaggtaagtattcagattttttattgttattgaaataatatatatgctttagtactctctgagacaatagaaggataaccaggttatgcttattttaatccttttatttgggctttacaatgtcaaactggatgcaatttgctgaaaattagatagctagataattctattttaagccagattagagctgggctctgttctattttctgatatgtattaggtagtttgatatgtggctgtataatttatcctgcttaaaatggtaattttgctcacaatattataattgtcataattccatttccttttcaaactgaattccaaatcagtaacaaaccactttcactagatcctgtacttttgagacgttggatgtcctccatttctttgcaccctgatccccttgcaagttgttatgtttcgtgactgtgccggttcatgaatttcaaaatgtgtttctggataaatatatctgaagtctgcatatgcgcatctgaagtgagcacattctcagccatttccctaccataaaatattaagtgttccaatctggccccggttttccttctgtctggtactctggacatacgtagaagtgccagcaattcagcaggttgttttttgttactctcgggtcagcttcttgattccgcctgattgggattaatgtgagcaatgtctataaaactctgtggagcacatggattcaatgttcataaggcagtcacacaaacacacgtgcacacagacacacaaatgcatgcatgcacacacacacacacaactctttactctagtttacttattagtaacaagattcattcttattagatttgtgggcataccgccaaactgtgtttttagctcagtagtgggaagtggacaagcagatctggatgtgccactggctgggcagtccaggagcgcagctgtcacagcaggcagaggagacagctccaaaccaagggacacaggagcccctggaccccctccctcccttaccccttctccctccctccctcccccccccccttgttgcctctttctctccctttttttctttctttttttctcacttctgagttccttttaaacaaaaatattttctggaatttagaaacaatagctcactggtggttgttcaacaaacagcagtatttgacatttttgaatatttgcagaaatgttgtaaatttaaagagttgctccaccttgattatatacagcagacgatgttagaatggccaagaccatcacaggtcctttcttgactggcgatgtagtaccggtctatagacttggacaacgtgatatgaatctagttactcattctaaaaagaattctaaattttgcttaaattattaaagatctttctttttcttctgtattttgtctcctcagccacatcctgcagtttttcacgttctattttttttaattcatcctctttcaatctaggttgaacataatacaaactgattttctccaagaagagtggaatatttttaccatcatgagactgtcagctcttgtctagtctattggcataccaaaccagaaaaagtgaggcctttgtccgttagtgcggggttaaacttcactctgccatttcccgtgtgacatgagacagaacatctaacatttcagagccttagtttgctcgcctgtaaattatgagcacggtgatgattactgtgctgggagcaaacttggttggcaaatcggaccccaggcatactgttggccctacgtgatgcccaccaagcagggcactatttacccttttgcttctccctgccaagtttctccataattaatgaaattgtttttcttgtatgactttaaattttgttgagagattttaggtgtttcctccctacaatttttcacttggacttttttcttcctttttacaaagtactgccctctgacaactgtgttttcctttgacacctgagtggatgtgtttgtgtgaatatttttatgcacttccaatgaagtaggaaaacccaagtaggtgttatctttaattttcccaatctaggaaatatattagatgcaaaaatttttttaaagttctcatctatcaaaaacagaagaaccatgcagagtaaagctttcttttatactggaataacactctacaactgctgttagttggctcagtttaggttttacggcccagcttaactgcatggacttatgcaaagactaatgtctttggagttctatataaattgcttaaatgagttagaatatctaagacatagtagtcaaataagttttcaaaaaaaatgccacaatgcaaataactctcaattatttttattgtttccttttaaattatcagccatagtttatttaattcacagatgagtatgatatcagagatactggtcatttgaacagtcttttggtattctcaactgtgccaggctgttagatttaattgtgagagttatggtgcggttgattagattgggtttctcacaaacatcaataatttgttttgcacacgtaacacaatagaaaatgaccgcttgctaaactaataaacttgtgctatggtatgaccgtccagttagtaaaagccacctttaaagttggttgcatagaactgtgggacaaggcaaacagacaaaataaacagacaaacacaaaataaaaacaaaaaaaactctgtggcatgttttaaaaccaaaattgttgttgttgttgttgtttttccttgataaagctatcagttagcttttgggtgatgtaacagatgatcacaacttcatatttaagattgtcataattgtaaaagtcaccggacaaaatcatccccgagtgcgtgtgtgctagttgttacctaaggattccacctgtgtagctctgtggtacggtgctggtaatattcatatttcacaaacaaattgacttctggacgtgagtgtcatggaaaaagaccatgcggcaaaaagtggcagaggtaagatggagccagggtttgctgtcatccacagtgaatgccgtcctccacggcatggttctgtctcacagagagggattgtctggggagactgctaacacttcagtccctttttatgagcattgattttatacattttgatatgaactttcattaagtttgcatgtttttccataggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggtatggaacaacaacgagaaccgaaacccaaatctaaatacacttcttacatgtaaattgtatttaagtataaatctccctaactggttccaagcttgtacgagtggaataattttttggtggaatgttggtttctggttagtagtggaacacttgttgtttttgaaaacagaggtaaggacacagacggaaccaccagtgggttcgccttttctgctgcccagacagagccgatttatcaagacgggaattgcaatggagaaagagtaattcacgcagagccagatgtgtgggagaccggagttttattgtgactcaattcagtctccccagcattcagggattcaagtttttaaagataatttggcggccgggcgcggtggctcacgcctgtaatcccagcactttggaaggccgaggcgggcggatcacgaggtcaggagatcgagaccatcctggctaacacggtgaaaccccgtctctactaaaaataccaaaaattagctgggcatagtggcgggcgcctgtagtcccagctactcgggaggctgaggcaggagagtggcgtgaacccgggaggcggagcttgcagtgaggagagatcgcgccactgcactccagcctgggcgacagagccagactccatctcagaaaaaaaaaaaaagataatttggcgggcaggggcttgggaagccggtagtgctcattggtcaggttggagatggaatcacagggggcggaagtgagtttttcttgctgtctgctgttcccgagtgcgatggcagaactggttgggccagattaccggtttgggtggtgtcagctgatccaccaggtgcagggtctgcaacatatctcaagcactgatgttaggttttacaatagtgatgtgatcccaggagcaatttggggaggttcagacttggaaccagaggctgcatgacccctaaaccataatgtctaatcttacaggtaatttgttagtcctgcaaagacagactggtccccaggcaagaagggggtcttttcgggaaagggccatgatcaattttgtttcagagtcaaaccaggaattgaattccttcccaaattaattcaatctatgtccaggaatgaacaaggacagcttaaaggttagaagcaagatggagttggttaggtctggtttctttcactgtcataatttcctcaggtataattttgtaaaggcggtttcacagacgcacaggggatgatgaggtacgggtgttacctaagcttcacctgtactcccatcccacctgcacacactctctcccatggccgtagtcaactgtgtgctcaactggggagtctcatcatcatgtagctttcccatttgtcactatgtccctctgagctctcgtcccttcaggacacagagagtcccattgtgcacggagttgatccatatggcagtaagtctgtaggtctctcaggtatgtatgccttgccttagcacagataatgggtacctgcattgttcatgttcaactttcaccacaaaaagagaaaaaaaatcagtgattgaactttatcctttttattccttcaaatatgcaatctctaagaaaagtttgcatcatcaaagcatttttgacatgtgaaaaagttcaacattttaatttcatgcaaaataatttgtatggcctttccttgaatattgctagatcaaatgaggttgaaaacgttaaatctagagcctaactttttttttttttaatatagttaaatcacttgtttccctaattccacagaatgcttagaaacagggctttgatatttattactgaaagaggctagtattttatgatgaactctttggcattattatgtgtagtctcacctaaaatataaaatatagacacagacttccaggattgaggtctgttaaactggaaatctaggtaggagcaaaaaagagaggaaactggagactaaaccagtgagcaatatgtctctagacattgccagcatttttctatgaaacactctttctgtgttccccttctttattttcttactacttagcaaacagtatcactcactaatcattccctacttgaagcacgagagagaaaaacagagagagagagacagagagagagagagagagagaacatcagagaggaagcaacttcccacaacaaaatggatacagatctgcttgcctgtgcatctattctctgctctctctctttttcaatggaagagaatgtacctcctacttaagggtaatcggggctgggtgtggtggcctcacgcctgtaatcccagcagtttgggatgcagaggcgggctgatcacctgaggtcaggagtttgagaccaacctggccgatatggtgaaaccacatctctactaaaaataccaaaattagccggcacatgatggcaggcgcctgtaatcccagctactcaggaggctgagacaggagaatcacttgaactcgggaggcggaggttgcagtgagccaagatcacaccattgcactccagtctgggtgacagagggagactccatctaaaaaaaaaaaaaaaagaaagaaagaaaagaaaaaagaaagaaaaaaaacggtaatctatcctatgctctaggtacctctcttcctactatttcagagacattatttagagaatattttctatttctgcattttcagctactatccatgaaattttccccaatagcatcttgaatataactcagatctgtctctcacacatcgacacacacacatacacacgtacatatctatttataattttaatgtaccttggacctcttgtcttcctccagcttctaatttctaaaacatagttccagaaaacttatgtaaacattctcaatttctacacctgtttttcacttctcctatctatttacctggtgtctaacatgatggggtcttctatcgacaagatcttctattgcaggagatgttaatgtcactagccctggaggcacacttcctttctcatgtctcctggtgacatccagcatggctaccatttctcttgacgcccttttcccttggcttcaggggccagaaaatctctgggttattctgctatctctctggctaagttgttattttctttgcttccttgaccacttctaactgactttagctatataggaggttggaatcctcctatatttccatcctatgctttccgtgattcaaactcctggattcaaagcccatgatggccattcacagctgataactcttgtgcctgtgcctccagctcaagtcttctgcaagcgccaggacacaatgtttgttttccacctcctctgggaatgacgcaggcactgaaacatgtgcccgaagctgagctcgcagttttgcttcccagcttatcctccagtgcccccatctcactaagtgtgaggtgcagtgttcctggaatctgcggctgcctccctgtgtcaccaccagtagccgtaactgctctcagacctttctcctagaaaatggccaaactcctaaatgtctttccagatttactcttccaacttctctcttctttccaaaaggcagaccggacttattccttttgtgatgaaagcgtttaccatgctttcttagattttcaggaaatcgttcaacatctataaggatctgctgtctctctggctaagctcttatttctgtctcccaggctgtggttctttctctgtctcgattctcacttgcccctctgaaatatctccagcagccacagtcctttctacctcagagctcttgcacgtgtagcaatctcagcctgcaatgctttccatctccactcccactctttggttagtcattcggaactgtttctatgtaataccctgcaggaggcaatgtctgagtactccgaccaggggaggtctcctcattcagaagcttgaattctgatgtgcttcttcttgtgtgctggtcacgagcattcccaccaaatctctcccattctctctacttctggactcaggatagaggtgccttcaaaatgaagtgtggtggtgtgacttgctttcagtgatgaaattggagtgaatgtcacttgggatggaaccctgaagagccaaaatttagtttgctctaatggccactcagtcatctggatccctgagtatctacaggagtagagttccctgccatcccaacctggaaccagaaggaagctgccttattttaagtcactgagatatgggatatggttttttgttttcgagagggaatcccactctgttgtccaggctggagtgcagtggcacaatctcagctcactgcaccctctgcctcccaggttcaagcaattctcctgcctcagcctcccaagtagctgggattacaggcacccgccaccatgcctggctaatttttttatttttagtagagacagggtttcacccatgttggccaggttggtctcgaactcctgacctcaggtcatttgccctcctcatcctcccaaagtgctgggattacaggcatgagccactgcgcccagccgggatattgttgttaatgccatataaatgaacctagactgacaggcataccctgggactttttaaaatcaggaatttattgtatacagtcagccctctgcatccatgagttctgcatgtgtggattcaagcactagagatcagaatattctgaaatacacaacacatggttgtgtttccactgaacatgcacagactctttttcttatcatcgttccctgagcgatacagaataacaactatttacacggcatttgctttgtgttcagtattataagaaatttagagatggcttcaagtatacaagagagtgtgcttagattttatgaaaatgcaccattattttatattcctcctgtaacccacctgcaaaagccaagggacaactgtatttctatgtttaaaggatgccttactgaaaacaatacactgcatgaaggtgacggtcatttctgttttacctcgctccgcgctcagcaggaagcgcagtgccttacctgtaattgctccccagtgcacacctgtgagctccatacttgaggtgtttattccccctgatgctaagggactttctgccgtgctgcatatacattttcggaagcacctgtgcagggcttgcctttatttgtttgaggtctgtgctccggcttcctcattaaattaaatcaatttttagtccctacgcattgcggatattgctagcaaaactcttttaaaggataaaaaattgtagctagataggaggaataaggtctagtgttctctagccctttagggtgactgtagtcaacaataatatgtcccatcatttcacagagccaggaggatattgaacattccccccacaaagaaatgataaaggctggagatgatgaacatacagatgtagtaattacccagatctgatcacttagattatatgtattgaaacatcactatgtaccccatgaatatgtgcaattattatctctcaattaaaataataaaatttaaaaaaaatatgtttttaaattcaaaacagtattacatagaaaaaaatttttaaaaaaatttagccaattcatgtcactgcagatactggcacaaataccatgtgtccagtcttggtaatgttggattttgtagaaggcttctttaagggattgtgctttcagccagagaagtatcagttacccagggatggtgggattcacagttactttcaggaaacatgaccccaaggattacctcaggcactggtggtcctacccatgtgtgcaaacagctctgagtgtaccctgggtataaccactgatataaaaatattatcaatggcagtggtgttcttctcttctattcactgcatctcttccgtcgctaccagaaatccgaaagggatgagccggtcacggtggctcatgtctgtaatcccagcactttgggaggccgaggtgggtagatcagctgaagtcaggagtcggagatcagcctggccaacatggtgaaaccccgtttctactaaaaatacaaatactagctgggcatggtggggagcgcctgtgatcccaacttctcaggaggctgaggcaggagaatcgcttgaacctgggagaccagagaccggggtttgtagtgagccgagatcatgccattgcactccagtctgggtgacagagcgaaactctatctcggggggcaaaaaaaaaaaaagaaaaaaaaaaggcttggttgtcctctctgcaacacatagacacgtgtatcactgttacatataattgtgaaaatagagccttgatcatattctaggactaacccggactccatagatgagccatcaattagtggctagatgtaatgcatgagggggggacaaagatccaggatgttccccatgagtctgccctctttgattgtaaatgatagaaatctgaatgaaactagtttaggaaagaagtgcaaggtgacagctgtgtgggctggggcatgtctggagcctgggcctcagtgacacctgaattctttttgcccctgttgtgattttcatagctttttctgccctaatacacatggatgatatgtccccaatctaaccataccctgctcagcaaggacaggaccctgcttctcctactgcaattgctaaacattttgggaacactttcttggtgggccagcttgtgtctaagtccagccactgaggccaggtggacagagactatgtgttaggtcaacttgggtcacagagtcagaaatgtgatcagcagacttcactcaagagcatgttttaaaggggaagaagccggttcacagagtcagaaatgtgatcagcagacttcactcaagagcgtgttttaaaggggaagaagccggttcacagagtcagaaatgtgatcagcagacttcactcaagagcgtgttttaaaggggaagaagccggttcacagagtcagaaatgtgatcagcagacttcactcaagagcatgttttaaaggggaagaagccggttcacagagtcagaaatgtgatcagcagacttcactcaagagcatgttttaaaggggaagaagccagttcctttaagaaggtacctggaaaaacaacataatacatatgccatggaacagtgatataattggattaaaactctatgtaaatgaagtatttgtatgcaagagatttttattagtgttttcttatgtcctcatgtgcttctgcagaagtattattagttggtttggaagagctaattgcccctgttttactatattaaaaataaattgcagcactttgggaagccaaggcgggaagattgctcaaggccaggagttcaagaccagcctgggtaacatggtgagaccctgtctctacaaaaaattagctgggcgtggtgttggacacccgtggtcctggctacttgggaggctgaggtgggaggactgcctgagcttgggagttcaaggctgcaatgagctgccatcacatcactgcactccagcctgggcatcaaagtgagaccctgtctcagtaataataatgacaataataactgttacgtatggtgtgctcactctgcgccacactctatgcttcctgatttccacataaattccaagggttatgcacatttcacagataagaaaaatgaggctcagagaggttggcaaattgtgaaaatgtgcacagctgcctgtggaagtatgatttggaatcaagtctgctagacaccaaagtagtagtgtcagccaagctattgtatttcagcagaaggaagggaaatgaagtctttggattctaaatccaacgatttagtcagtgcactaacaggggaaagaatgtttaaacctaatgaagtcagtttaaaaagaacaattttctcccacaagttgcaaaaccactcgaccatccctaagctgcagaacggccactgtgggaaaactccgatcacagtttttcgttttggacctgacacctgacagatctgcctgctcctctcaagttttacggctgtgaaaatagcctcgccaaaaccctgagagtcaaacgttctccacaaggacttgcagcgcatgccttcgtggttggatgcaggtgctgcctgtgaccgtggaatccagatgtccgctgtggctgcattgcctcttgcagatccagggtcatggttcaggaactgcctaacatcacggcctccggacatcagaacccttgcccttgatttgtgcagcaaacactggcagagctctttctttcttttctttcttttgtttttctttttctcttttttttcttgtttttttgagatggagtctcactctgtcgagaggctggagtgcagtgatacactctcggctcactgcaacctctaactccctggttcaagtgattctcctgcctcctgagtagctgggactgcaggtgcctgccaccatgcttggctaatttttgtagttttagtggagacagggtttcaccacattggccaggctggtctccatctcctgacctcatgatccgatctgcctgcctcggcctcccagagtgctgagattacaggcgtgagccaccgcgcccggcctgacagagcactttctaggactttgcaagaattcgaccggcctttaaggccatgccaccctttctcagtttgacttgtgaggcagctgcagcgcagcctggcagtgagtgtcatgagcagtggtcagttcatggagggggaatgagtccaacctgtaggtcctgagccagcgagaggtgctgggcactcctgccagcagcctcctgtctcttcgcctacctctgatcacactcacccctccccttcccagagctaagctctatgcccgcccctcctgactgcagccctaaagcccagccataggtttctcctcagaaccccttcattcctggtgggttaggggcttcactctcgtctgccggtgtccacgtgagccttccagtgtaacagtaacaggattgccttctgctcccaggggcgcctctcttcccctgaggccaaggcacccccagctgctataagtggcatccaacacaagacagacccaagctctttcaggagagactgaggacgattgtaaaggggaggctctgagggatcctcaggtcagccggcatccccggagggtagtggaaagtagcctcctgttgagagagcagtgagatagaaagagcaggcgggggacccaggaagacagcagcagccaagaaggggccccattgggacagcagcagccaagaaggcccaggaggacagcagcagccaagaaggggccccaggtcggcctcccccaggtcgctgaggagaagctgtgtgccggcccacgctgcagtgggtgacatccaggggcctggggaaggatgcaggctcacgcagagctgggctaatacgccttttattccagtgtatccataggacaggcaagtcagctaacctcatatgaggccaagtgggagaggttcctcccaggtgaacggagcggcaccctcagccttcttgtagacctgggcgaaggagggtcttcccacttagatatttcctggagcacagaaggctgggagtgggttcctaaccttcctgtttcctgtttcctaggattaaagggcaagaagttggagcttgtgtagctcctgagctccagaaagaaataagagcttgggcttctccagagtagtggagtcaaattaggagagagtgagggaaggaatgatatggtgaatagttgtcttgttatgcagattacaattgctcaggtaataaagcaactgccctcttgatgcagctattcagaactacttttgtatctgcagtttctcagaataatctggtggaaatataccaaagaagtgtgttttggggtggcatattctggtcttctagagtcatattttggggtggtgtcctgagccccaacactatctagaactgatgagactgaactcatcaaagtgacactttgaagacaaacagcttactttcatagatcagtgtttaattatttccatttttgaataaaacattattgtagtattttataacttgtgaaggtctctgtaatctaaacccattaagttgtattttaagtcaaatttttttgaaggccgtctatgtattaggctagcatgagaatgtaatttctgtgccaagagctaggaattaaaaaaaaaaaagatacatgggtgttttgtaaaataatgtcataatttaatagaaaactagattttcaattacaaaattaaaatccaacatgatcctctctgtgactgagatatctgctgaggtctgagggtaaaacccactgggtggcctcgcagagcaggcacactgagcaggctttccctgagaaagttccacgtgagcagaacctggaggccacgtgtgaaccctggcttacactagaggtggcattatggctaccaaaggtgaaggatgagtttggacatgagccagtggagtgatggtattggattgtgaaggaatttgcatcccctgttaagaccatgaatttagttctctacaccaatagttctggggccttgaggatagaattcaaggaatctattactcagatggtaaatatatacataacaatattatgtatttttccccttaagctttaattaatatttagcatttccttacattttaaaggcaggcaataatattaaaatagtattagcaggctgggcacagtggctcatgcttgtaatcccaacattttgggaggccgaggcgggtggatcacctgaggtcaggagttcaagaccagcctgaccaacatggcaaaaccccgtctctacttaaaatacaaaaagtagctgggcatggtggcaggcaactttaatcccagctactcaagagactgaggcaggagaattgcttgaacccaggagatggatgttgcagtgagaagagatcacgccactgcactttagcctgagcaatagagtgagactccatgtcaaaaaaaaaaaaaaaaaattagtattagcataacctgtgactttgtcaccaaatcatagataatccattgctttgtttcatttagtgcagatatttctttttttattttattttatttatttattttttcttttttttcttttattattatactttaagttttagggtacatgtgcacattgtgtaggttagttacatatgtatacatgtgcagatatttcaaaatgttactacaccatggtttgaagttgcctcagttattagacttggccatgtgttgtttagtgaaataacatacataatgttaagccacaaattttgctttatcgcacttttgtaggaatattttaaaatggctggtttcctttgtaatcttatgtattttattttatacagtaagacattagtttgagaaacttattagacttcccagaatgccaaagtagttcagattaaaacagttatgaacgctggaggaccgtaagaaactatcgcggattttaaagtgagaatgacaatgaccttagacacattttaagagcctaatctggtacaatgtagatatggactgttacagaaacacttgttgcaaatagagtgagactggaggcaaaaacatatgtttagggcattgatttgaagttgcagccatagaggctgcagccgtgcccaggctgaagctgtgttagtggtgcctgctgtggaggaaatgattggggtgatgtttaggttgtgagcgggggcctggggtctgccactctctggggtggcattgagatttgaaggactggaaggagacatggctgcacgtgctaggaagagttctgggtggagagaagcccgatgagttgagagaagagaaaggaacaaggctggtgcactgggagcggaaggtcagagggcttccccgggtcagggggcctggggatttggctgtgacgcattcaggttgttttctaggtgcaatgtgatgtcactgaagaagctcaagcaaatgagaagttgcttacatgcagagaatgaattgtatgtggatgggggttgggggaagcgagggaagagtagagcaggggaagcagtgaagaggcttccaggaattgggggcgggaggctttcagctccaacacacctgcatcgcctcgtctggctgtatgcacgacgtacaatttgaataatgtgaatgatgaatgttgtgcttctctcccatcttcctgctcaactgtcccctcccttgccccattcctagtgaactacatcctgttaaaatacaaacacttcctccgtgatcatcatgttaaacttgctcattacatggtaatttccatttttaatgagcatgatcttaatatctgagccaataagaaaaatagaacataattatatgccataaaccattaactgtcaattaattggtgtatctcagttgacaccaagcacttgcaagtctcccacattttgaatattcttaataccatattcaacatttaacttttcttttcttttttttttgggacagagtctcactctgttatttaggctggagtgcagtggcgcgatctcggctcactgcaacctccgccccccgggctcaggtgattctcccatgctgaatagctgggattacaggtgtgtgtcaacatgcccggctaaattttgtatttttagtagagacagggtttcaccatcttgggcaggctggtcttgaattcctgacctcaagtgacctgcctgcctcagcctcccaaagtgctgggattacaaacatgagccaccccgcccggcccagctccacagtttttttttaaaaaatggttttgttgctgagtagctgggattacaggtgtgtgtcaccatgcctggctaatttttgtacttttagtatagagaaggtttcaccatgttgggcaggctggtcttgaactcctgacctcaagtgatccacccacctcggcctcccaaagtgctgggattacaggcatgagccactgaacccggcccagctccatagttttttgtgttttactcttgatattttacaggtaaggttattaaggccatgtctatgtagttccaaaagctaccaattatttcaatctgtaataatggtctataaataaacaaacaagcaaacctgcaaaaagcccatgtaggaatcatctagagcacaggtcagacaattgctttggttgactcacaaaatatttaatatttacaaaaatcaattatcagtatttagaattccatgttatgtaatttatgagatacccataaatcccctttccctttttctcctgcaatagcagagtctggaaatatttgtcctgcattcccacgtaggagagaaccctggcaaagtgggcctgacttcagggcctcctctagtttcttactgtcttgctcattgatgttgactccgtggcctttgagcgttagaaagcataagtcctctcctaggtcaagcatctggttggctaagcaagtgttttatttgcttcacacttaactccatgctagtattgtttgtcacgcagcttttaaaggatttgtgagatacccttagatctgctttccctttgtctcttgcaataggaggatctggaaacattggtcctgctttcccatgtcttgacaccccattccaagccagatgtcaaggagaagaaaggactttcaattaaaaaaaaaacaaaaactcgaaacaacatgttttttattgtacgccattaatttcctatcactgagatataaaaataaataatacaaataaatgagaacatgaatttgagctattttattttcttgtagggtatcatatctgacagaggtgacacttaattagatagtttgtcagtgtttgccattttataaaattgataaattgataagatgacacttaactctgatatgtaagtcaaataaacattcctaggttctacttgagatttagaagctaagcttataattaataactcctaagaagatgcataaatcatacagagaattcttgtcattttcaatgatgtctgtgctgtacaccttattcttaaagtttgtcatttatttatgaccatgtaaaggtcagagatgttactatagacgtagctgtcttgaagttaaatgacttattaagaactttggtaaaatcaagccatgcactctatttctaagtcaagaattgaaaaattgataatagcatgaagatatttatcaactaactagatattagcgggaaaatagacattagggggattactgcatggtctcgttgcacttatgatttaaaaacttgatgtgaataatagttatttttttcagatctaaacaaaggattcctttataaaagataaaattctctgtgttattttacttttgttggtattgccttgggcttattgatacttagattttcataatactcataaaaattttgccatgttaaagattttagtgacttccttttcttttaggttttgcaatttggagaagttaagtccctccctccctcccttctttccttccctccctccctctttccttccttccttctttccttcccttccttccttccttccttccttccttccttccttcattcctccctccctccctctcattccttccctccctcctttccttcctttgttctttagtatcttcctctctttcttttctgtgttataaagcatattgctgcattctaatgcataaacttttttgggaaagaaaacttattcaatgccaaaatctcaaagataattttaatgctttaggcatagcaagtaaaaatgtcttttattttcaaagttccactgtttttcttcttccttttgctatgtgtgccaaacaccatttttaaagataatcgaatgtgttaaatctgtttattcttcatcacaatcataaaactgctgaattttatgtgaaatgattttcttagaaaataggctatagtttgttataccaatttttcccctttagaagaacaagcaattaagccacctccaggcacaatgaacatctgaacaattcattctgaattatgtgagcatgcaaactgttgcttgtatacaaaccataatttgtacataaagttgatatgcttctaaaactgcatcattccttttcctttcaacgggggattctgagcgactttgagtaattaggggaacagggcaagggtgcttactcagtctctgtttttacccgtctgcatgagtgaattgagctttcaacctaaggctttacaaagatgcctcttttgcatgaaagtgcttccaacagtgaccccaaagagttgtagcaatccccatccccgctagggcaaccatgtacgagacagaaaaggctaagattccccttagtttgtggacaagactcttagaaactaggacctgaatcttcattgttgacggatgttctccctgcagatcacaggcatctactccttcttgtatgggttttctgaaagcaaaagcaacactctcaccttctcctttaaatgatccattcctctgaaccaaaagctgacgttctcagcgtgcatcagtagacccgtctcctaggtgaaggcaccttcagatttccacattccacttgctgcaagcctctcttgcaatgcagggagcacgtttcatgtgcaggctggtcctcccgaagcattgatgtataagcctgtagtctcagcgaggcccaaaactctgacaacttttgcaacagtttggttggcttcataagcaggtgctgggactaggagctaagagaacaaatggagcataattaggcagaaaatatgtcttagagttgagaaccagggtgatatccttggttataaagaaagagtgatatgctatcccagaagtttagaatagccgatagatatgggaaattggtgagcttctgtatgtgtgcacttgggaaattctgtggactaccattcatggctgacatgctactgagaccccagatggatcttttcattgatagggaagctgaggactcaagcggggcttcaaagtcttcagtgtacaccttgatgtaaactgcagccctattctctgtagcaatgcccttttcttagagtgattcaccctaattcccaccaccagaagcagtagcctcctcctgggtctgtctccatcagagcagttgctcgagggctttgccttgattaatgagaaatattttatcaaagaaactagacaattctttccatcaagactaagctttactgaactaatatatgccaacactgattcatttcttttagcatcccatttaattctgtggcccttgtatagatgggtatatttagtctcctttcatgaatgaagaaatgagcctcctgggattaagtggaatgttcaagtccccgtattggcacaaccaggctgaactcaggtcacaccagggtgcctcacctattttgcaaaactacttcaaggctcatgtatgtactgccgaggtagatttcttcatgtgttgatgattctctaattcaacttttttctttttttgaggtggagtctaactctgtcacccatgctggagtgcagtggcacgatctcagctcactgcaacctctgcctcctgggttgaggtgattctcctgcctcagcctcccgagtagctggggttacaggcatctgctaccacgcccagctaatttttggaattttagtagagataggatttcaccatgttggccaggctggtttcaaactcctgatctcaggtaatctgcccacctcggcctcccaaagtgctgggattacaggcatgagccacggcacctggccttaattcaactttttaatgacagataatacaacaactcttatagaactaatagagagaatgccttcagaagtctttaggaattgcccagtatggggatgcagaagttgtgaccttcagctgaatcagaatttgtttgataatcgtggcttttaccaccctttaccctagaaggtaacttctttatcaaattccactgaagtgatctttttttctttttctctcacttgatgactttctttcttaaattaaaactttttatatgtttacaacccatttatgagggtgaatgcttttatgatgggtacagagcaagaaggccatgcgtgatgagggttctgacagcagattgacgcctccttcgccctctcacacctgtgtggcctggcactgtgatgcattgcaagtccttcagaggcacctgcaagaagccagcacaggcactatgaaacccatcacactcacactaaacaggatgcaacaggatccttccaaaattcttcagcatactcaggaattatcttcatgacttatttttagttatttccattcagactcctaatatagtcctttataccttattgtgtgaagtgtgacagtgaatccaagtttggaaaagacatttgagaaaagagagaatatgactttatacatcaaaagtttgagggaatatcggtattaatatttaagtagttaagtactcagtttaacaagacatttggaacaaagaccaaaaaatagtgtaactgatgctcttacttagtgatactcttacttagtgtatagtttacaatagaaaaagaaactaattggcattttaaattcttgagataattctgaaatgagccatgggttttgaatcatcattgtcatcattatgatgttgactggcagatgggatttatcaggtgaaaaaatgggtcctgggtttttataatatgtctgtgtccacttataaaatgtgttctaatgaacgtcctgtggtctgaacaatttgacgactacttcgtctccacttaggaggtggcgagagtgtgaaaaggggcacacactttaggagagtgtgaaaaggggcacacactttaggagaaggggctgcagaggtcatctctcttctgaaactctccccttatcccagacactgaactctttctatgtttagaacacatactatttcctttggctgaaaagcctgcctttcttggtcttttcctgatctgcaccattttcctacttagatcttaatttaaacgtcatttcttcaacaaaacaattttgaccactactgcataaccttaaccaggttttatattttctttacttcaatccactttttattttttaataataatttatgcaacttacaattcttttatacaatcatctatgctttaatttgcctaaattcaccagagtaagacgcatttctagtttccatttataactagcatttataacagagtagagtcaataaataatctttatttcactcaataaatgaataatgaaaaccactgtactgcccatatgggctaatctgctcccccctccccacacgcacacaggataattgttttgttgccattgagaaaagaaaaaaaaacaacaacaatttttttcagtgattagagtagcccgcagccattgggcttagaatctttaattacaacttcaaatgtcctatttcggtgtttttcatagaggttattttcatgagcagaagggcgctagagccttcaacactagttttacctatcccaaaaaagaacttaattgtacttcttaagtcacccgaaagactacacagccaaactaaggcaatgcaatgccttacatactattaacactcctgtgttgtaaatgtgtgtgtgtctctgttaaacgctgttttaagtgaaggttcaccaggagtacctatgaaccattaacttgttaatattgtattctggtaattgaggcttgtatacttccaaggcactgctaattcgtggatgaaatcttctaatgaagatgaggttctattgaatctagttttatttgcttctcctcctctagaaaccagcaatcagctttccatgtttttttttcttaacgttttattagcgttcatatttgctgtacagtaggactcatttttccaagagagtttattacgtttaaagcaaaacaagaatgagaaatgaattgctgatttcattctaaaagagaataataaagaaggaaatgtgttgatagttgaaactcagtgtggaattattcattcttttttgtgagcatgggtctctaaagcaattttaggtccaaatagcagtattgggaggaggcattccaggcactgtggatgttttctaggccatttggcagtggctttcaagaaaaggctgtttttgtggacttcagcctggagtggtccctggcagaggcagcggtggccttgctatgcatttgacaggttggcccagggagccacacgatgggggaatgcagatgaggggtgtgtgtgtcagagaaagagagagatgctgatttggcctggctttctgttttaatgttccctgtccctacatttatcagcttagatttctaagcatctagtttttcaaataggtgataacaacaaaaacaatcaatcatgagggacacgccactgtagcctttgagctacgtcctttaagacataattgtttcataggggtttgaatattcttccttcgaacacctggagaagtttttccttgaagccaagtatgatgtaaaagattccaacagtccaatattctacttatcagacacaaaaacaactgagaaacactattgtatataatgtagctactgtatggtggactgttatattagtccattttcacgctgctgataaagacctacccaagactgggaagaaaaagaggttgaaatggacttacagttccacatggctggggtcgggggagctgagaatcatggtgggaggtgaaaggcacttcttacatggcggcagcaagagaaaatgagaaagaagcaaaagtggaaacccctgataaaagcatcagctctcgtgagactcattcactatcacgagaatagtatgagattgattggaccctctgatgcaattacctcccctgggtccctcccacattcacaacatttgggaattctgggagatacaattcaagttgagatttgggtggggacacagccataccacgtcaactgcaaattccattttcacaaaattgtgagttaaaaatattttttattttgcaaactttattaatagcaattgtgcttataaggtttattgatctatagtaaatctttgtagagtgtctctaatcaacgcagtagttccatggtataatgtagctttaccagaaagcagcactggaacattcattcatttttttatttgtaattacatatttttaaagtaataacatttttaattggcaaattataattgtatacatttatggggtaaaagcattcattctataactagtaatttatcttggattttctgtatataaagcttgtaaatattgagttataaagattacatctcaaaagatagcactgagttaatcagaatactcattttcaaacactgtttctaatttcatattatcgatatacattaggttggtgtaaaggcaattgaggtttttgccattgaaagtaatggcaaaaaccgcaattacattttcaccaacctaaaatacagctaattctctataatatttaggtgcattataaataaaatgtaataactttatttgaacttatgacagtttattaagttttatcatataaattacttgatattcacactgatcttgttaattaggcaatactcctttgtatctgttttttgtttgtttgtctgcttgctttttatgagacaggatcctgctctgtcacccaggctggagtgcagtggtatgatcatagctcactgcagcattcgactcctggccttaagcagtcctcctgccccagcctccctagtaactgggaccacaggcatgagtcactgctcccagccttttacatctttagatagtaggtaaaagaggtgatgtctggagctcttagggagcccccaaagctctgttagtaatgagcgacataatccagtgggtttctgggtttcagaggctgcccagcgcttccctccaggtgaagtttcctcctctcccgctctgggaggaatttgtctcacatagtgttcttcccacttctcgtccctgggggagccaatgccaggaattatctcaagatgcttttgccactatgtgtcctctgatctcgatttttcttgttctcaatcatttttctgctgcgtctctgactcttgttcagagacatatcattgcataaatgaaaataattaaaaccaagggatgctgaaaggttaaataaaggattttttttaacctgctgactatagtcagggcttaaccacaggaagctgttgtcaactgcatagtatgcttacaatactgaaaatataaataaatacacagaaatctatacaatctgtgactattgaaagatatgacatttcatcactggcatttatgagtctctccctattttttttttgttgttgtttggatttctgtagtgtaaataatgctgcaatgaacatctttaaacattcacctttttctgcttagaaattatgctcataatagagatttctgtaaatgtattactaggtttaatattacaactgattttttatggccctattctaatgactttcccaaacagttgtggcaaataatgttgccatcattgagttactgaaatgactcactagcattgcatattgttatttatttatttgtgatggagtctcactgtgtcgccaggctggagtgcagtggcgtgatctcggctcactgcaaccttctgctcctgggtttaagcgattcttctgcctcagcctcccaagtagctgggattacaggtgccggtcaccccccctggctaatttttgtatttttagtagagacagggtttcaccatgttgttcaggctggtctcaatctcttgaccttgtgatccacccgcttcggcctcccaaaatgctgggattacaagcatgagccaccgagcccagcctgcacattgtcattttaaagaggcaacaatgccatttcattagtttattaaataggagaaagctatggataataacgaaacctcatggctctatggaatgcttaacatttggcaaatgttaatgaagacaaactccaaacagcacttacattaatcttgtgaacgccaaggccacgctgtaggcccacatattgcgttgcctggttgctgtcttccatatgttctcacattatctttatgttgatgtccaattgctttaatataaaacacagactgattcatattctgagccttagctgcctcttaaatctaatccctgagtaatcccgcatcaagctctttgtgttcccatcccctgtctgctggcccctctgccctgtcctatcttctttctggcccacctctctttttctcaggtcctgaacacagaaacaaaaaagtctagaattctgggaaacacctgtcataataatatactgtttccttttccagcatttgtttacaagtttccaaactacaggctcactccaatattgtcaatggttaaggaatttacacataaaattgaaatttccatttcacttcattctccacagaaaaggcccctctgcagaagctcggagactttattttatgacttgattttcagttgattgtgaggacagtgaccggtgacctcatgctattttgaaactcattgtgttgcctggcgctgagggttggtttcagcagaattacatggcagggcggaggttcccccagaactggtgctgcatggtgtggctttgctgctgcattaggagcaggttcccagtctcatgggaactgcctttatggacaaaggtgtgcctaaatattcaaagatgctagagagggcttctactgcattgagtactcacgccctcttcccagagtgggcgagaggctcatttagctttaaaattacagtatcagatgatacctgatttatggattagttaattcttactcattaatgagtaaatgtttaaaccacacagactgcaaacatttattatctcttgtcttacctggagtttattctagggaacataaagactgaatgataaagcacaataaatcatgttataaaaaattgtactgatagtagttgtcagcttagggattatacagtgttttttttttttttttttttttttttttagaaaaagactaaaaaaactgcaatggattttcctgttatatttgtatagttaaaccaaataacgacatattttccagttaggagtactcagactggtagtatatttcctatttaaaataaaagggaattattaggtatatgttcacccaacattttttgtaggctccttttattattacttgcatttccttttttttggggcgggggacagagtcttgctctgtcgcccgggctggagcgcagtggcaagatctcggctcactgcaaacttcacctcccaggttcacgccattctcccgcctcagcctcctgagtagctgggactacaggcgcccgccaccacgccaggctaactttttgtatttttagtagagacaggattttactgtgttagccaggatggtcttgatctcctgacctcgtgatcctcccgcctcggcctcccagagtgctgggattacaggcgtgagccaccgctcccagcctgtattactttcttaaataatttacatcatatgccttttttccaaggtaagcattataaaatttacttttggtatgtgctactttccttttaaagtacacactatttattaaatgcatatggttatgattctactactactaataataattatattggtctggatggcaactgactacttagaaaatataccttattaaacttatccaacaacttcatctcaagcagtcacatgtgatgacactcctgcaaattccgaagtaatttaacctcacaaatataagctttattttgtctgtttgtttctttcagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatggtaagttcatcactttgcatgggggcgatttaatgtttcatgggcataatagcacattaaatattaaatgaacatatccagtaatttattaatgtattcaataaatattcgttgagaatctattatgttttactcactccacttagtatttaaggaatatgtcgcatgctgttaagttagaagtaaagaaacaatccttgttgccaaggaaattataaggatggcaaaatagtaaacacaagaggaatggtatactgagctgcagggaaggagatggcacaggcttgggaagccatcagggaaatctccgcgaagtcagcagcgttcagctttacagtggttatatcagattgtaggaccagagggaaaaagggtacttattaatttgatccttggtgtttctttttgtttagcttttataataatttcatattgattttgcatttcagaaaaatgagctcatttttgtagtgggccttgaaaggtacatagcattttgctactcggaggtggaacactccaggtagaagaaacagtgtaagaaagagcgcagtgtacaggtagccataggagaaaatagtagagtggtttaatagtgcaagaggggctctacggagaggctggaggcaagttctcgtttgatggtgcaacagaggacctggtctctttagacgtcctttttctgagcaggaatccttactttaatgcttctgtgtgactgcctcatttttatgatgactttgacattttttcaatatctaattaaaataaatagatccatactatgtgtaggaagaatgcatatgcaatagaaaatttactgtaaacccgatattctcacactatacatacaggacctttgaatgaaaaaataatgaaattaccaactccgtggacctttgaaatgctaagcacttgtatcctgtggggaaaaggggaagacatctggctgtgctttaatttctactgaagaagtaaaagaagcatatcagtaggcttttaaaatcacagtttttatctgtatttacctattctgtattattataaaaataactacaaacacactttgggaggctgaggtgggcggatcacaagatcaggagatcaagaccatcctggctaacacggtgaaacaccgtctctactaaaaatacaaaaaaattagctgggcgtggtggtgggcacctgtagtcccagctactccagaggctgaggtgggagaatggcgggaacccaggaggctgaggttgcagtgccctgagatcgtgccactgccctccagcctgggcgagagagtgagactctgtctcaaaataaataaataaataaaataaaaaataactacaaacaattctttagccacattttaaaagtattttatcttaatctaatatttatttaattacatataaaatagcacttaaaattaattttataaaataaggatagcagtaacctatctgggctgtttttcattaaaacattttttaaatctttaagtctactttccgttctagaaactcatatatatgtataaattcttttgaaattatcaggattgaaacctcttcttatttgcaagtttggtgtgaagactttgaattcatatgtaaatggtagactctggcttgatatttaaaaaaaactacaattaaatatttaatttgattttattgctttctcaagctttgtttttcaatatggaaataactgctctggcttcgaattattttgtcagtgtgaaaataacaaaatctaccttttttgatagaatttaaagtgatgcctgccacctttcctaattctaacatggtatataacaccatctagaattagctaaactctgcatgaatttaaagcctaaaccccttcagactcccaaaaccagcctgaggcttcattctccattagaagaactcagagacatctctaaaactatcatgcttgtcattatggttttaacagggaggggatatgtcaatatattccagggaaaagacacatgtggcagagtccaggaggatgccacatatctctctgatccatgccaagttctttactaaacaaacatttttactattatatttctatttttaccagtactcgtaaacctaataaagaaaccgaaacgcacgattcatgtaaaagtttatcataaatattgaaaacaattagaggacctatataaaggattttctaagaaccatccaatgtgtgtttaatatccttttcatattaaaaaaggtgttatttaacgcaaaaggtgctttacttgtgaaagtttatatttcttaaaaaagtcgttgcttcataagaatgcggaggctgttcaaacgcctattagttacagttatatggcacttcagtctttcccagagacagcggtaaacactgctgacaacccagtatcttcatgtaacatgtattttattaattgacagtggtttatcatttcaggtcagtgattgctatataggtcaagtgtactgaaaaaccatcttcaaaggtccagccctgtagacttgaaaagaacttcagaaaaaacacagatactttaaacaacttctcgatgtctttattaaaaattggccagtttagataattaataaaataattctaaatcccaaggcatcagtcttcacaagtatatatgaaatcaatttgtatttatatactgaaaatacatgttaagctgcataagaatctactttatgaaattaatatagtataaatttatctgaaaaactgtgatctgaaattatgatatctatgaaagtaaacaaatgaaagaatatgtctctgaaagttatctgagaaattgaagacattatttttctgtcagtaacataattacacagaagtctcagttaaaaaattaaaaaaaggtgggggttttaggccgggcacagtggctcacgcctgtaatcccaacactttgggagaccgaggtgggtggatcacctgaggtcaggagtttgagacaagcctggccaacatggcaaaaccccaactctactaaaaatacaaaacttagccaggcgtggtggcaggcacctgtaatcccagctacctgggaggctgaggcaggagaatcacttgaacgcagaaggcggaggttgcagtgagccaagatagcgccattgcactccagcctgggtgacaagagcaaaactccatctcaaaaaaaaaaaaggggggggggggattgtaattgttaaaatatgattaagtagaatttggtttattaacttattaaatgtaattttctaattaaatatgcattcacacttacaaatatagttcaacaatttaaaatattttgctgacctaattaatcatttaacactgaaatgtttatgcataaaaatataattttaggcattaaataaatcttaaacactatcataataaacttgacttaaatgcattagtatgtgtagagtggggaattgcacagacagagataattattagtgtaaataatatgttgtgataggtatgttaacagcttctttgaatttgacagattttgtaagcagaaaacaattttattgcaaaattgacatgagaaatgcaagcagctaaacaatgtattattacatacatattttttaaatttaaggtttaccaagctgattggtaaatacagaaaataatctttcccaataatagagaataaaaataactataaagaatgcaactctgtctccttatttttcttacctgcattcacaaatacagtctttaaaatctccattaccaaccggcaatttccaagacagagtgcgctctggattcttctctgaaaatgcttctaaggaaaccagagtaacagaaggaagaaaaatgatggcaggaataactctggttctctacacactaggggagattaaactttcagtatcttcgatatattgagagtcaagatatttttatattaatatatatattataacatatttattatatttttatattcatatttatgccaagtgtatttattagctttttaatatggaatttctttcatattcttgtttaggcaaaaaacttaacataatactagagaaaaccatctataaatgataagtctcttagcaaacgttcaaggttttaaaatttaaattattttgttttcactttatttatttatttgagatggagtctcaggctgttgcccaggctggagtgcagtggtgcaatcactgctcactgtagccttgacctgccaggctcaagcaatcctcctacttcagcctcccaagtggctaggaccacaggcatgtgctcgcatgcatggataattaatgttttttgtttgtttgtttgtttgtttgtttgttttaatagatgggatctccctgtattgcccagactagtctcgaactcctggggtcaaatgatcctcctccctaagcctaccaaagtgctggaattacagctatgagccataacagccagcctgttttaattttaatttgatgtaatatcacttaatatgcctatccatctctcttcacagaaagtcacattgcataaagagaggaaaaggtagcacaataaagagatgtttccttgtacctccgccctcctgtgccaaggtgtgccaaccccccagttgattttctggtatcttcgagctgtggcttcacacctgagcaggagtcagtcacatatacccataacttttgtgtgtgtgaatcaccaaaagtacccccttcccacttctcagggatgtcaatgaacgaagggaagcctccgtggtatttgaggcaatgatagagagtggcgttgtgggggaagccagtggcgccagggtacctgggcatgtttcccattgggcgtgacattcaagttagacatcaccgccatcactttcaacacagcgactgctagctctagaatcggatcaaaatatgtagctttcttatctttatgtgcttattcttggaaaaatacatgagcaaatagcttgagcaattccctccttcactgtcttgcccagcaacgctctctcccacgtgaacatccgggtattcatgagcacggaaatgcctgcgcgtctctttactccatggctcctgagagtggagggagtgtagcctctctatccctttcagttgctgatgccatggtcagctgtctgtcttcctggtccggcttggaccagtgtctcccaggcagacaggtgaggagctgggaggtacctgctgtgctccacgcagagcttcctctttgatctcagtccagactccactttgaaccccgccttcagggaaaggaaggcaggggggatacgcttcctgccgagacacgcacacttcctgcagtggcagatcacaggcccccgtctctgcggagctcagtgagacgccaccacttggggaaatgcaaacgtgcctttgatgccactgcagcgaggataaagacggtctggaagtagataaagatcaggccaggggaaatgagagaggaaattttgactccagattcttagggtcctctttttttctatctctggactacccagtgggagggcaacaggattttgctttgagagaattttgtgtgcttatggatagaatattgttatcttatgtgatgatgagcgtctgttattttccttcacagcacttgcacccgttgaattttaaacttctgtagtgtttgcttaatatctctcttcatcactattcaataagctttttacaaaggcagcaacagggtctctacggttcactatggcatctccatcccaggcacccttactggtacataacccactctcagtagatacttgttgagtgagtgagtgaaaagatttgttatttgaatttgatagataaatcatggcaagaatcactgacttgctcaatgttatagaggtattcagtggcataaataatactggaatcaggaatgtgttctaccaagaaaatcaccacctcatttcttttgccctttaagaggtgggaacgatggctttttgttttgttttcccaacaggaagggtgctactatatataatgtggttatgtaactacaagattcaactagaaaagcagaaatgcaaaagggaaaccttagcattgtaagtccacactaaattactagcacggagtcacctgtaaagggtttcagcctaattggtttcatgagttcactcttaaagtgctctctggttattctctaattcaccaatttatcaatttgtttatcatgacctgagctagacagtagggactcttgaaaggaggtagcagctggggtgggaggagatgcagaccctgtctgctagaggctgacagtctcgtgggagccgtgtgctctgtgagcagagcctggacctctagagccggagcaagcaggaaagaccttaaggaagcggtgacaaggagttgagttttaaaggaagagacaagtttgccttggcagaaaaatagaagaaaagcatgtgaacactccctcgacgtctggaggggaggaaaagtgcactgccaacaggagacaaaagtagcttgttatggggacagcatggtttatggtcccattattattattattatttttagagacagagactctgtcacccatgctggagtgcaatggcacaatctcggcttactacaccctctgcctcccagattgaagcaattctcctgcctcaaccccccaagtacttgggattacaggcgtgcaccaccacgcctggctgatttttgtatttttagtagagttagggtttccccatgttggtcaggctggtctcaaactcctgacctcaggtgatccacccacctcagtctcccaaagtgctgggattacagaagtgagccaccgtgcccagcctatggtcccattttagagatgacaagcttcaggagtatcgcagaccctgacctcatagaatttatagaagtggaggctcccagggataatttgcttctccagcttacaaatccaggtttgtctgactccaaacctcacttagtaataattacgcagtaaaacttctaaagtagtctctacatacagtcccttcttctgatgaaaagatccaaatctccagccaggttcaatccaatgttcttttcaaatcaatacacatctgtgcagttcaacagtgtatcatatcccgcctcatggtatattctcatttgttactaaacttttctttttgtttatctgtttgtgtatttgggcctttttcctctacctgaattctataccatttgtggcaaatctttgacagcccttcgaggttcaagagagttgtgaacactcatctcacacctcttagctgttggtttgatttcagagttcaaagttttatgactttgatgcactatatgaatatttaaattaaagactatatttcaggttattccattagtgtttggacatgtcattttccataaataaaataattgccattaaaataataaatataaatttcttaacaaaaatgaaaataaattgggtattgttttagttcttcaagtcattgaacactagtaaaaactggaaatgcttccgcaaaacaccacttacataatcttacattgcattatcttacttcttcaggtatagatctgtaaagaattgataatgtctttgttttaaggcaagtagacttagatgacactctttcagatggcttataaatagggtctagcagtgtgagttagaaaaagcagttacatatttatgaatactttccccataattcattgtgctggacactcagatgggttatcagcaggtcacaagtgttaactaaggattttatttgaggcatagaagaataaatttatcctaaagggattttgaagatatggagaatatattaaataaaactgagataatttagcttagacgtataattcttctaaggtcttcagattttagggcagtaattttgacaaaatggtgattcagaaatatttcacacctatttcccatcaggaaaaatgttggctaaggtactttggagtcaaatatttagctttctactctctaaaatcagctgtatggcgcttgttttttcttggtttcctttgcagccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttggtatgagaacctctcaagtcaaaatatctgtaattgtgatcaacaattctgacttagcatacatatgccacttatatacaaggcacatatttagaataaacttcttagatactagagaagaaattcaccaacgaaatccagagatatagggaatcaatttcacatagtacatgtgggttttgctacatggtagaaataggcagaattatgtctgtgtgtctgcatctgtgtgtgtatgtattggatgtgtgtttgtgggtgtgggttgggttgggtatgggtgtgtgatgtgtgtctctgtgggtgtgtctgtgtggtgtgtgtggcttgtgtatgtctgtgtggcttacgtgtgtgtttgtgtgtgtggtgtctgtgtgtgtgttgtgtatgttgtgtgtgtgtgtgcgtgttgtgtgtggtgtggctgcactcttgttggagcccacagggggagcaggagcagaagccagcagccagggcaagtaaggcaggacctggaaatgcatgtgaaggccttgggctttgttcttggggcagtgaggatgcacctgggctctgacaggcagagctccaaggccagatatgggctgcagaatgacgggctcattttgtgggaaataaagtagcagagggcaagaaaggagactggctttgaggttgtggaagtaaatcagacatctaagatgacaacgaccagagtcagtggatgtgagagtgaggagaaacagaatttgaaatattaggttgaccacaatgaaactgccgttttaaaaccaaaacaaaacagcattctgtggttggccatgccccatagattaagctccatatttagaatggaaaatctcacaggtgttgacatttttattttatttttttaatttatttctttttgagacagagtcttgccctgtcgcacagctggagtgcagtggcgcgatcttggctcactggaaccagcgcctcctgggttcaagcaattctcctgccttagcctgccgagtagctgggactacaagtgcgtgccaccaggcccagctaatttttgtaattttagtagagacagggtttcaccatgttggccaggctggtctcaaactcctgacctcaggtgatctgcctgccttggcctcccaaagtgctgggatgacaggcatgagccaccagcaccggtgagtgttgacatttgacaagtgccgagtgcctgtggaacattaatgaaagacagagactggagggttcctcaactttgtggacattcaacatcttgatgtttacaaacacagtatcctgagaatgcatatgttttattgcttttattaaaaaaattaattcattagccaaagtttccataaatctcactcagaagtaaatatccttagccagccacctctttctgtctttcctagggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacggtcagttgattttcactccgttagttaagactgagaattccatgtggtgtttcctgcagtgttgtcccacgccttgtttccagctgaagtttcttgattcagccgagggcgtgtatgattcttttgcactggaggccagcgtttcctgtggtcctttttttgtttaatgatgtctttattatttcacatcgtatccagcttggatttattccaagatacatgtatcctaagtgaaactctaagatgaagaccattgaaagagatttggtaccttttatagatttactcatccctgtctcaagataaggtgttatagcaaatgtcatgtaactataaatggtgtgaaagcaaacctccaataatcctgggaatgcactctaaacgatatgtagaacatctgtcaatcaatcgcttatctctcacgaacactgccacctacagaattcctcaggacacgggacagggcagacgttatcaaatctgcacatggacagggagccaggttgtgactgttgagtcattcttgcagaattccaaacatctgtaaagtgtgtttatttaaatggtatactttaaaaaataattgtacacttttttccttgggctttaactgttttttggcactaaataataatatgaacatttgaagcttgggaattttataaagctatgattcaggaatagagacatttcagtccgtgtacttaagcattataacaactgcaagatgaatgttttgtaatagttgtgtttattcagcaagtgtaattgcaattattattattctttccattaatcatttagcatttcagctcaagaaatgtcaacctcccccagcggttccacaggcagaaatgcttactgaggatgatgatttcgaaataggtaatactttcttcattacaataccatgaattcagcacgacatttttttacacccacttctcattgtaatcattactcagacaagttaatgagtaatttgtcagagaaacaaaaacagaaacaaagaacaaactatccttaaagtattgctgagaacttatacggaggtcatgtatcaaatagaaaatgtctgtccctcttcattaccatgatttttttttgttttgccatttgaattttgatgtcagtttgaacatttttttcctctacaacatttggtagttcatagtttttaataaagtattcagagacagacttgggcagatatttgctttcagttagggggacacattcatgcacttgagaaaaatctgaatcatttgcggctgaaaggatgattacataacagtgacatttcattgaaactgggatataataagagaaaatatttagtgatgatatttaggatttctgctgtatctttttacattaatgatctaatttattcaatactcttctggtcatactgagaaagcagtgatggcatatgtttatggtatagttattgcaacccaggatttttcagccccagttataaaactctgccctgtgtttcagaccactggtcaaactacgtgacccaatttctgctgtcctcaccctggcttagttaattggaacattgtgctaagtaccaaggtcagagatgagtctctgtggatgctgtaaagccatttgattttacagtcttgcttaaaccatagcttctactttactttttttttcttttcgtcagcaatcactggggaagggaaaccaacacggatgcctcagtcaaggaagaaaagctgccacatcatttcagtactaatatcggctaagcttaatagagcatttttataaattaagaacttaaaacggtattatttttaaaagactaaaaataaatacagacatagtttctaaaaagatttgcaagttgatttaattcatttaagtagtcctacatgtgtcacaccttcacacactcagaaggtcacacacaatttcctggtttgttgcattgactcttctaggagattttgtgaagtaccagtgccaccccgggtacaccttggtggggaccgacattctgacttgcaagctcagttcccagttgcagtttgagggttctctcccaacatgtgaaggtatgcactgttcgatactaaaactacataaacttattcaacatggaaaattgtattgtttgtattggtctgcatttctttgtatagatgtgaacttatttatttgtttattatttatttatttatcttggagatagggtcttactctgtcacccaggtgggagtacagtggtgcaatcatggctcaccacagcctcaacctccctggtctcaggtgatcctcctgcctcagcctcctgagtaactgggactacatgcatgcaccaccatgcctggctaatttttggatttttttttttttttttgtagaaatgggttttcaacatgttacccaggctggtcttgaacttctggactcgagctatctacctgcctcagcttcccagattgctaggattgcaggcatgagccactgtacccagcctgcacttaatctgtgctctgatcccattgcaatgaaactaacatgctaacagaaatatctaatgatgctttttcttttatctagtcctagaaaataaaccaaggccatatcaaataagaaatcatgtttctcacagcaatttatcatgtaaatgttcaaacatggcaaagttgaaataattttaatacctgaataatgtaacacctgaatatataccacctagcttccgctatgaaaacttacaaagtatttcctttatcacatgcctatctgttatctttctagccatttattaagctacgctatatttttgatgcatttcaaggcaaattttgaatatcatttcgttttgctataaatacctcagcatgcatataattagctggtgtttaatattttgatgtaaatttataaaaaatgaaacatgcacatctcaagtttttctcacatatgtttaacatatgtagaccatgtgcaagagtatagacaatatacaataatagaacaagatactgaggctgaatctgttgatttaatctattagaagacaagtagattacttttaaaatattaatagacaccactttcaagtatcattgaatgaaaaaggcttgaaaaactttacataagctcaaatgctcaagtaagtcgaaacatcattagttcacctatccaaaagctttcctaattagaatagtttttatgacttcaaaatcatagtgaagtgcagatgtagtgcttttgagcattgtggctctttcaaggaatccaactattgtcattccttagggtgagtgacacagctataagggcccacgatttaggaagacaggacccggagccagagtcaccccatcaggcagctttgagcaagtcactcttccctgcactgtgcacacagaggatgatttatccgctttatttttgagattgttgtaaagactcaccgagtattaaatgaatttatctttttgagtgttttataatgttaactgccttccctgtaaatggaagttttctttgcaaaagtatcgacttcgcagtggttttgcagatgctcacacctgtgcatggatcctcttcaaaggtctgataactggccgggcgcggtggcgcacgcctgtaatcccagcattctgtgaggccgaggtgggtggatcacctgaggctgggaggtcgagaccagcctgaccaacagggagaaacctgtctctactgaaaatacaaaattaactgggcgtggtggcgcatgcctgtaatgccagctactcaggtggctgagtcaggagaattgcttgaacccaggaggtggaggttgcagtgagccgagatcttgccattgctctccagcctgggagacacagcaaaactctgtctcaaaaaaaaaaaaaaagaaaagaaaaaaaaaagtctgataactttgtgcattctcattctggaatgaggcaggattccaggcaccctgaaagagagaaacagtcttctacatctgaagaaaaattggcatacattttggaatgaattattatcagatatccataataacttagattttttttttgaaaaaatattaacattgaagttgtatctacatgagaactattgattacaggaaaccgctacctgagcagagggccagacccttggcctgctcgtctgtttaaacgctaagcagaccgtaggctgtggaagtcatcaaaatctgtgcctctaggttgccttacttagaagtggggattgcattgggtgcaaagtcaggagatccaagtcactgtcttcttagaagaaagccaacgtctgtgccatcttccaggagcaacaatggtctatttatggattctttcctcaaggtggggggatataaaaagtgttcatcttctgccattctatatggaaatgaacccaggcaaaccttcacatttttaaggtacattttaatcccaacaaacaaagcctcaagtttctcagaatagaagactttaactaaaggtgatcttagctgagaagagaagaaaggcatacgtatgtatcaaatgtgctgctctaaaaacagggaattttggtcagggacagtggctcatgcctgtaatcccagaactttgggaggccgaggtgggcagatcacctgaggttaggagttcaagaccaccgtgaccaacatgaagaaaccccgtgtctactgaaaatacaaaattagctgcgtgtggtggcacgtgcctgtaatcccagctacttgggaggctgaggcaggagaatcactggaacctgggaggcagaggttgcagtgagccaagattgtgccattgcactccagcctgggcaacaagagcaaaactacatcattttttttttttaaaaaaaaaaggaatttgattagggtgtcctctccagatgaaccaagttcttatttaaatgacgtttaattcatgacaagccaagagcagagaataatcacgcactgcatgacgttttgaaccgtgacagaccgtgtagataaatgtggtcctgtaagattataatgaagctgaaaattcctaccaccgagtgacgtctagcagttgcagtactacggggccacgcattaccttttcaatgttgagatgagttcagatgtgagaatgcttacccttgtgttccagttgcctacagtcttcagtacagtctcatactgtgcaggtgtgtggtttgggagcaataggctacaccatatggcttaattgtgtagcaggctgtaccatctgggtgtgtttaagtgttcctggaccaaactgaaggtggggctgctatttttcatgtcccaataacgagatgcagataaactgaggaggaagagagtttttatttctataactggttacagggagaaggcctggaaattatcgccagaccaactcaaaattacaaagttttttagagcttatgtacctccttagctatatgtctatgtgtaagtgtgtatttatttaaagacataagtgattaactttttaaaatctacagctaaggtctgagtgctgaagaccttcctctggagcctcagtaagtttactgaatctaaatgggtccaggtgctggggtgattagtcttgttttgtctcccgctaaatcacaaaggtttggggagctcctttagaccccaataaacttgtttgtggaggcctggggagtttcttcagaccgctaataaaactcgttgaattctaaaagggtcctcctgttaagaattcttttgttatcttgtcatgcttcaaggcccaggagaagcctagggaaaactctttgttaccttccaggctttgtataaaggcgctggctcttacagcttttaatatttaacggaaacactccgttccaggctttgtataaaggcgctggctctttcagcttttaatatgtaactgaaacactccgttagtatggaaacagttgttatggaggcctgcattggtgagagtggcctccctcagaagtgcatgctgttatctttgcatgatgacatgatcccctaaagatgcatttctcccagcctgtccccatctttaagtggcacatgtctaaatcaacacaacatgagcgttattctctaaatttcctcatttgtcacagacagttacagggagcattctgcagacaaaatttgccgacttttactcacgctgaagtttcccaagccccactccacacctcaggaggcgaacaggataacctagttctcttctctttcaagtcacgagtcaatttgtttaaaacaaccggagagtgatcttagctgtcattctctaaacaactcatcatttgaaaacaaacaggaaataagaccctagatgtcttttaccaaatccttaatcactgaatcacttaattatcatctttctttaagtacttttctactatttgattgattcgattgtgctcaagtgggggcccatctcccaataaattcttcagaaaaattacgttagctattagtctgtcttcttcaaatgtcataaccacacttttagaagttgtgctttgaaacttatcaccatcccagcacttttggaggccgaggtgggaggatcacctgaggtcaggagttcgacaccagcctggccaacatggtgaaacgctgtctctactaaaaatacaaaaattagccagatgtggtggcagacatctgtaatcccagctgctctggaggctgaggctggagaattgcttgaaccccgcatgtggaggttgcagtgagctgagatcacgtcactgcactccagcctgagcgacagagcaagactctgtctaaaaaaaaaaaaaaaaaaaaagaaaaagaaagaaacaaaattatcaccaattttagggaaacaaggagagtgcattgttctttgaaagtcaggattggtcggatgcggtggctcatgcctataatcctattactttgggaggctgaggggagcggatcacaaggtcaggagatcgagaccatcctgggtaacatggtgaaaacctatctctactaaaaatacaaaaaaaaattagccaggcatggttgtgggcccctgtagtcccagctactccggaggctgaggcaggagaatggtgtgaaccccggaggtggagcttgcagtgagctgagatcgtgtcattgcactccagcctgggcgtcagagcgagactccgtctcaaaaaaaaagtagtcagccttatatggagatattactgtgctagacactcatcttaatgtagaaaaacctgagtaagagacatcacagaagtggcttttctcctgttaaggaaagagaggcatttcaaaaagtgaagagaattaataacaaaggtttggaaacacaaaggagggtgtggcgttgaggaaaaaggaggagatggcttcctactgcttgctctcagggtgttttgggggaagaggtggtaaattaaatcaggctggaaagctagactaggacctgactttaaaggtcttcaacgtcaggtttcttcatcctgtggaccttgggggatccttcaatagtttttagaatattcatttctttagaaaaaaaaaaaaaaaacaccatacgtattcagtgaacattaaggagattcagtgaccttctgataatgatcattcgaaagcagcagatggaggcgacataaaaaccgccgctgcccagctccagcttccttctatatgtgctggataatagcaggcatcacaagggctctggggcagccttttccctagttcacagagggctcaccttctccaattctgtcatacctataggtgcttttaagaataatcttagttactcataaatcccaatttatgctattaatcctagagtactaatcctcatctgctattagttttgctgaaggcctatgagatgcgttgaataagatgctttgggttttaagcctcacattttatttttctttaaaaacaatctggggcactaacattgtgcagaaggatcataactcgaggcgcaggtgatgtctgagagaggcaagctttcacgtgtgtttttgacaggtgctcccctatggtgagaggtttcccagattcccaagtggagacacagttgttttctaatgtgtgattgctgctaagaaataaacatctcagctataggaccgcactgcggtccctttcagctctcccactccaactgagtattgctctaagcaacagtttataacactgaggagaaggagtggttccatatgaaagagcagaagaaacacaagaaaacaaatcactttcgctcatgggtaaacacctccaaatgcttcttaggccgagcatggtggaggttgaggtggaaggattgcttgagcccaggagttggagaccagcctgggcaaaatggcaaaacaacatttctaaaataaaaatacaaaaattagccaggaggggtggtgtgcgcctgtagtcccagctactcgggcagctgaggtgggaggattgtttgagcctgggaggtcaaggctgcagtgagccgtgatcctgccactgccctccagcctggcttgggtgacagagtgagaccctatctcaaacaaacaaacaagttaaaaaacaaaaccaaacctcaaaacaccaaaaaaccccacatgaattttgaaaacaatatgtatgactgaaaaaagtattgctaagtattttaagaaaaatgatacaaatgataaatgatacaaatgaaaaatggtacaaattctctacaaattatctgctacctctttggttggagagaattgtagaaactgagagtcctctgtaaactagtgggaattatataacaagttgtttatattttcattttgtctttcctaagaaacaaaatcagcatttcaaatatgaaaggaataagaatggctatgcttaaaatgctgcttctgggttagatcattgcactgctgtcaaaccccaggatgtgcgaataggttttcaggtggattttagcaactcagtaaaggtttcttacttccagatggcctgaagttccaatgtcaactgataactatagctgcagttataaaatctcagtcctcataaaaatgcagggtagagagattggctaactgtttttcaagtgtaatcccacaaaatgaaacgccctctggtagcatttttttgttagtataaggtcagcctagagaaggatgaatagacccaaagtcaggtgaataagtttattgaacctgccatctgctccaccacagacagaagaggcagccctgagcttacaaaatgaggggtttatatgggggagagggaccctggggttgtttgttggttaactttgccatatattatcttgtgacgtttatggcagtagctagatgaaggaacttacaggagggtgtaggtaaagtttatttatgcttcccacgacctccctctgtgtggtctggatggtttgtaattgcggtttgcttattgtagtaaggtctgatgagtgaagtctgctggcttcactgcagcgcttggataaggcttagaaatgtaaagaggcttgggggaagggtgaacggcacggagaagagttgcagggcattaaggggagaggtgggcagtacagaggggtttggggggagtgtcggcagtaccgagaagctttttggggcggttggtccctaacagttatgaaaaggtaggcatgtggtgtaatcatccctagtccttacaacagtttctgcccacatagtgctttagatttaaaaaaaaaaaaattgtgtatattggctctaattaaaaccctgagggggagctattattactctgtacttacacgtcagagccaaggaaagccctggttgttattgcaaagtcaaggcgggtctgtggagcttctaaaacttgaggtcctagcctgcacagatatacacaggcacggaccctaatttcattattttttctttcttaaaatatcacattaactttgaatgggcatcgtgtattttacaaagcgatgaggtcaccatcacagaagaaaattagacctttaactcagttgtttcaatctgtgtgttctgattaggattattttagtttatattattgccattaatttatcattgtaagtatttttaaaatctcacctaaaatatatgttatttaaagagttctatgaaatgttttatgattggtggtcttatgtctaaacattttctaaattttaaaatatatgttaattagaatgctaagataaatggaagaaaataggaaataaattacttttcaaaaggcagttacttgaataaaaacacatatcataagcttcgctcatctgtttgaaaagcttctatcttgaaatgtatgtataaatagcacacatttaactaattaaaaggcgataactcaataaataaatttaacaaaagctctttttcattaaggaaaaggtgattaactatagaactcttaacactctacaagtaattttgatatacattttttatttttgaaccattaccagtaatagaaaaaaatttcccttaatagttttatacacaaactgtttctggaagataattcagtgatgagagaaattactaattaggagactctagtgttttgctttgcatgtccagatctctgcagattgtttttatgttgattaaactggaagtagttgaataataatttttcaaaaagcaagaggagaaaagatacgatgtatccatagtatcttcatgatacatttacaattaattcatcccttaggaatcagggctcctgctgagatgtcccatgtgggattgagaccaggtctctaattcttcctcttcccagggtcccgagcaatcacatcgaacgtttaaatattactatgctaagtacagtagttccccccacccccgatccgaggttttccattctgcaatttcagttacctgtgatcaagcacagtctgaaaatattaaatgaaaaattccagaaataacaacacatttaaaattttgcactgttctgaatagcctgatgaaatctgtcatcatccccgggctatgtctcacccaggacatgaatcccagctttgtccagtatatccattgccctgtatgatgtgattgcaccagaaacgacgtaggattctggaccatctgcagcatcaggcatcactagggctcttggaatgtatccccaggggtaagggggcctactgtatatttaaagccaaaataaatatgagttttcttttcttattgcataacatttcactgtatttctgtaatactcttttgaaatggtgaggttcttctttgtagtagagttaggaaatcttgcattgtatgatgaaatccaggatgcatctgccccaaattaaggtgtgtgggagatgcaggggccaaaggagtgtgcaggctgagtgtagagaactgcaaagagaaagatgcacaattctcatgattattcaatgttgccctccctctgtgtttgcattcggtattaaatttggccagagctcaataagattgctttttcctttcattgacttgtttatacagggatagaaactatcctattgcagttggaatcattttattaaagcaaacttttgctggtacttttctctccagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggtaagtttctttaatctttgtagagcagtgacctcggcatcattgataaaaacactattacaatgttttagtaacataaagactggaatatattcttgagttaacttatgttttcccaaagcaaacaaaaaataaactagtttggggttatgcattctcaagagatcaagcagtctgtaaaacattaccatatgattgttgtactgtattagtccattttcatgctgctgataaagacagacccaagactaggaagaaaaagagatttaatggatttacagttccagatggctggggagacctcacaatcatggaggaaggcaaggaggagcaagtcacattttacatggatgacggcaggcatgagagacagagagagagaaagagtgggtgcacgcacatgagagagaacttgtgcagggaaaaatcccatttttaaaaccatcagatcttgtgggacttactatcaggagaacagcatgggaaagacccacccacatgattcaattacctcccaccagatttgtcccacgataggtgggaattgtgggatttacaattcaagaagagatttgggaggggacacagccaaaccataggattgttaacattgtcacttttcaaacagttagaatgcttaggaatacaccctgaaagtgtaccaaattttctttaaccattatttgatttttttaacacagtgatttagagaagatgatctcaataactctttctctctctcctatatgtaatatcaattcacaagatattttaggaaacttaggcctagaggtatttttgtcatctaaataattattttactggaaatatgtaaaaatcatggctcacagagatttctagatgataaatgctacaggagtttttcaagtgtgattctttgaaatagtgaaatatggttaactgaacacgtgcaatactgttttcaacaatagtcttatgatttttttgcaatttcaatgaaaattttaacagtgatatgattaaaagtaatatgtggttgaatcgtcaatttgaaatggaaggaatgttaatatttctctttgtgtgaaaccgtcatagcccagaaaattagaccagttacaattatggctgtacataataacagggttttcacatattttgaaagatttgtcattgagttcagataaattacaatcaattcagtgaaaaaaataaattattctaatggatttgatgtgtgtttgtattcactttactgagttgatgagtcaaattgcttgtatggatagacatcactgaatcaattaatgtattttcaaaaatgaattaataaattggaaattaaactcacatttttgtatatagaagcagaggactggagagcaatattttcattttcagagcatggctttttaaatgtgtatattaaaacaaacatacattatttacaactttttctttagtctgtagagtagagagaagtaactcattacgcaagtataaaaatggggtttctcttgttgaggaagaagagaggtaaactctatttgaggcctattaggtattatgcaaaaattaaaatgtagagcatccaacctcacaggctgtatgtctgtgtttgtgtttgtgtatatatagacatatatatccctacaaaggacataaaagtatatttaattattttgaacttatgcatgttcttttgtttcacagtagttgaattgaaatatactggccatgcttttaagtctcttactttcaggagcaaattatttatcaataatttatgcactcatggcttgcaatttgatctcctgcaaatttggacagatcatagccattataaacaacaggtaaaatacgttagagacaatagcataatacttgctgtcaaaattatcagaaatcagtgactaggattgtctggtcttaaagttttttctacaaagtgaaaggtcagagttttatgtgaatatgtttttaagcgatgacatttttgttgcagtaaatgtcatgttcatatctttctgtctctttctctctctcttttttttttttttttttttgtaagacgggctcttttatagttcataggtggaccaaaaaacatgttgaatatattgattttatactttattatctcaagagtatattactctctatggcttaagtagtggatatcccataatgctttttaaaacacagtattttaatcattatgaaactcagttgagaagactgtcaaaattaaaattacagtgtacactggtggaatacttagtttccattttggtaacagaaatggataccttcctttactgccgtgctggttttctgcacatgccagtttgaatatgtgcttttaaagactattccttctagaaagttagttacattttagacaaagagaacagatagaacattatgagggttcagatgctggattaagaatacctaaaactggccaggcttagtggctcacgcctgtaatcccagcactttaggagaccgaggtgaatggatcacctgaggtcaggagtttgagaccagcctggccagcgtggtgaaaccgtctctgctaaaaaatacaaaagttagctgggcgcggtggcaggcgcctgtaatcccagctactcaggagcctgaggcaagagaatcatttgagcccaggaggcaaaggttgcagagagccgagattgtaccattgcactccagcctggaaggcagagcaaaactctgtctcaaaaaataaaaaaataaaaaataaaataaaataaaaaaaaccctaaaactctactcttgagttctgtcattaaaaatgacatttcaaaatatcataaattcaggttaattaatttaccagtggcattttatctcagaatatacattatccttttaaacgccaaaaagcaaaccaacataccaaacacgctttgtctttgattatgaaataccagccactcttttgcagggcatctcccaggaaatttagccatgacatttttcatagtgagatctattaatatcatttcttctcatcctccttctctctgaccaaagtcagcattgcccgattatttaatatgctagttttggtttgtggttttttgttcgtttgtttgtttcacatttctttcctaggactgccatgacaaagtgccataaattgagtggcttcaacagaatttttttttttttgagacagaattttgctcttgttgcccaggctggagtgcaatggcacaacctcagctcactgcaacttccacctcctgggttcaagcaattttcctgcctcagcctcctgagtagctgggattacaggtgcctgccgccacgcccagctaattttttgtatttttagtaatgatggggttttaccatattggccaggctggtctcaaacttctgacctcaggcgatccactcgcctctacctcccaaagcgctgggattacaggtgtgagccaccatgcctagcctcaacagaaatttatgttctcacaattctggatgctgaacctttaagcggaaggggtcagaagggcgggactctcctccaagcctccctcccaggcttgcagatgtggcccccactcagggcgtgcctgtgtcttaatctccttttcttagaaagacatcagttatattagatcaggacccacccatactacctcgtttaaccttagttatgtctttagggaccctccctctctctctttaaagtcacatttccaagcccagagggttaggacttcataggacttcaatgtgtaaatttgagggggacccagtctagtctataacagtcttacttgaaaaaaatcatgagaactgctctgattgggagttacacggtgagtggagtatggtttctcagtatctttgcacaaataaaattttaggtataacaacaaagacagctgtcactttacttcatagcatttgtattatgaacaacaatgagagctgcattctcccagtccataatgtgttccctaggagtgaactgtgaaatgcaaaatgccatgaacgcttttacgagtatgagataatgctgagctcattacagagtagcgttgttggcaagccccagtgccatgaagcaatttctcctgaaaaatggttttgggttatggtgatgagggcaatgccgggtgactctccactgtgctttcttttcttacctatactttcaatgttaactttgttgtctcaacgtttttaaaacaatttcaaataccatagacaggtgaaaaatgaaaaaactagatatgaatttcagggctttgtcaaatttactttaggccctcatcttataaagaagcaatgtgtacaggtaaatttagaagcttcacccatatccaattccacttgtgcctctcctagaggaagttagtattctgaagttggagttgcatgggtcatggttatgcatgttttataattatttgtgtatctatcgtccacagatacacatgttatatgttgcattttttattttttgtataattgttatcctattatatttatctctaaatatatatttttagtaataatctgttatgttaagaattacctatgtggatatgtgtatatctagtttgttaattttaatgctgtatgaatctaattctttttcatggaatcttcaattctttttttaaaactccaaattactagtttgatctaaaatttgccatgagaaatagtgttagaatacacatgttcactatataaataatacttgcgtacatgtgctagggttcatagaaatataattaaaccttcaattttactggatattaccaaacagccctccaaagtgattctactactttacgcttccactagtattacatgaaagtttctattttcctgtgtaagtacaatattgtaaatactaacaacaatacatattactttcatttttttcgggtactgctgttttatagacaaggcttatttaaatatgacaccattaatagcatatgcacctgaaattctttttgtacattattgtcttatttttatcagaaaatatatctgtcactatagccatttggaatttgttgtccacttttgtaataattatatctgtgtattgcacacgtagactccagtgtaatcaaaagctaaacctagtatgcatttggtaggtgctcactcatctctgaatgtttttgtttttctgtttcacttaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcaggtaagtaaatgaggtttagattttatatgaaagtattttaaaacaggtgattttcattgaataaaacaatttaaatagaaatttatagtataatcctaattcttaaagattaataattaactacagtagaaatatatgatgggtaattattctgaatgattcctctaaactacattaggaaatttgttgcttaatatttagaattttattgttaaaattataaactgctgaaattcatattatagaaagcaaagacattttccaaaagataaactaatataatcaaaattaattttaaaatatgtttaaatggtaagcaaacaaatagaaaaagataattgtatttctattaattgcataagtgatgataatctcttactattaatagttatgtttttgtatctatctgcaggtctctttatgtatgtttcacactacatatatgtgtatatatatatttgtacaaataaccatatacataataaatatatgtttaatatatattcctcatcaaaatgtaaattattttgccctttatatactgtaatcattctctgccagcagtgatttatattaactaaatcaattagtaacaaattgatcaaatcagtcaatatatttattagacattaaatcctgtatacaatcatcagtaggatctgaccacactattctttaaactttcctacagaagcagtaggcagactcttaattcctgagcacatttcaattactaagcagaaaatctaaacttttctcaaaatctcactcagcaatgcccttgacagctttcaagttatgttttcccgtgaaagatgctcattgtgtatgggaagtgaacaatatgtgctgacggaggattgtttattactgtgttggtgttttacgtctttagggactacgagcgtccaaagggaaaaccaggaaacagtgttaaaacagcagttgtaagaataaggttttagctcactctggttggtagacatataaaatggtaaaaagcatcaagattttgaaaggcccttgatgtgaggataacaggcaagaaattcagatattcttcctctggaaggtttaataaaatatactcagacctttgctgcaaagacatcgatgcaatgatgggatttgcattcagcaaactccttgttccaaaaaatagatagtcagactctttttttttttttttttttttttttgaaatacagtctggctctgttgcccaggctggagtgcagtggtgcgatctcggctcactgcaagctccgcctcccgggttcaggccattctcctgcctcagcctcccgagtagctgggactacaggcgcccgccaccgcgcccggctaatttttttgtatttttttagtagagtcggggtttcaccgtgttagccaggatggtcacgatctcctgaccttgtgatccggccgcctcggcctcccaaagtgctgggattacaggcgttaagccaccgcgcccggccgatagtcagactcttaaaggtgtttgaatttttccaatgtggaaacatggtcagctcagagaaaatcatgatgaacataatttatcttgttttacctgcagagaaattcttagtagcctggtgatatgattatatcctcaattgtgagaacaatgatttctacgtctttcaaaaggtattttatttgttgtcataccacaaggagagcctcattgttaaactgtattgggagaagaagaatacacaattttatgttgtttaagtggagagagagagagaaagagaggcagatagatagacacgtgtcatatgtgaatataaaaaattctttatctatctcacagctttttacttagaattgatgactcagtgatctctgctaggtcagcatcagtaatttttgagcattgattaaatgaaagtgtccctaaaatattaacatgtggccaagggaactctagcccatgatattgtcacatgaccacacgttgcatccccaacatgtatttgccctatgcacgtaaactcttgatcattcaggcataaaagcaatataatgaatcatcataattggaaatccgagttaaaaacgacaaagaaatgcctgcgaacagtggttctggacaattccgtaaactgtgctaagcgcaggctgaattaacaatgtccttttcatactatgagaagcaaatgaaagcttctgtattgggcgggttgaaagtacagactggtttggcattcacaccgaaattccagaatatccacctgtcccagtcttctctcacctgggtacccattagacttttcattctatatcccagcttttccgaggctgcaccagcagagtggaaggaccaggccctgctcctctgaattcctcttcctgcagcaggagttgggctggcagggcccctgctccagtctctctttgtattctgtgctatggtttcccctgtagggcccttcatgtcttatcctaagtgagttaggaaagaagaggtatgttgaggggctggtgagagaagaaacacagtaaaagaaaacggagccttattggaatctgtagagttagagcctcatggtctcacttcctgcaaactttatttaacttatctatgactttggagaggaatctacagtctgattgttccttctattttttattaacttttttttttttttttttttactagcacagtgattccaagccattgatattcagggtgcctgattgtactcatactttgtctaaactaagtattttggttcattcaaaacttagaagaatttggtctagaaataactggaggtagaacatggtgtggccaatggagctgtgaatcaagagattcttatggtagtggattttcagttaagaaaaatcagcccattaaaaaaaaggaaatggtacttcagaggctcacccagctgagaatattttctgaggacacttctcgtaggaacatggttgacaactgaggccagacacatagatgttgcttctgggcaccactatgatagaaaaccttcagaaggtttcttctgaatgtatttccaaggaaaggagcaatgttaagcattcagacctgcgtgtgtgtgcttttatatggaagccccagagggaagtggaagatctaaaattctttaaaaagaaactgagaattcccagttcttaaggaccttctctgttgtattgtttaaattcatctgaagtgagttcctaggattttgtgtagtagtgacctcgccttatgcagtagtgacctagccttgtgcagatgaagcaagtttctttgtctaaacgtgtaaataagatgcagagacttttagccataaatatgacattctgtgtgggtaaaattattattttaacaaatgcccatctctagttttaaaatgtctccttacaaagagggatgattaaagctattgtgagattgtaattgactcaagagaatgcattttcttcaaagatttcattcaaatcccatatgctaaaaaagaaggttaatatctacatcattgtacagtccagaagtttcactgaacagtcaaaaggaaagaaattaatggccttgattaagaaaatgttatatatttctactttctctgttttaacaacacttaaaaaacacgcagaatatttttgtttcaaatatgatgtcttgtgcagtaccctatcacttttatcctggtgacagatgtgcttatttaagtcagtaagctgctttagagaggtgagtgaggtcattcaaaatgatccctctagaccaagtcaacctgcagcctgtgggctgcatacagcgcaggatgactttgaatgctgcccaacacagatttgtaaactttcttaaaacattataagatttttctgcagtttcttttatagctccttagctatcattagtgttagtgtgttttatgtgtggcccaagacaattcttcttccagtgtgtcccagggaagcctaaagattggatactcttgatgtttctcacagtactgtattcaggatcctagcttcacattgactcagagctgcagatcatctcaacttcagagtaagagacttgcctcttagactctcaagttttggaatgctctttagaacaaacttacatactggtgctcatttcctaccttttggaaatgagaagccattcatttatagactctcacaaaggcaatggcactggccatttgtttgcttgttgacttatttctgtgtgtgtctgtctgcccacagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccagggtaagaaatgcgttttcatccccagccttgtttcctgtgtattgctctcattttaatcactctctgaaaataaatgaagcactaactaagaataaaaggtaaggaaaaattgaatgttggcttataacagtacgaattaaaccttctagtggccatgcaaactttcctgacatgtagttgtatagcctgaatttggagaagggttggacattcactagatcctgggtcaagttattctaacagttgtacttcctcttgaagtaaaaaacatgtcatccaatttaagattcaaaataatttttctttaccattgtattaatttaaaaacattaatttctggaaaactcattttctttattttagtttaaaaactcattctttgagccctaagctctgtatttgattttgttttgttatttaaatctagagcttgttaaagttgatttcagtatttcatgccttttttttggcattttatctatcatgtgcataaaaatcaggttttcaaataacacattttaattttaattgaaggctttgaagtcatgaaattttcatagttttatcttatcaaggtttatattcataatgaattatattagtctttgaaagctaattatgatttatgagtgaaagctcatataggctctcttttttgtcagtttcattagatattagattttctggtattgctttgtgagacagtaatagatacttatcacagttattgtaggtgcctttgactgtaagaagttgatcagacagcctgtattatttatgttttacctctactgtattatttatgttttacctctaaaaattcgtatttaatgtaaaataaacatagagatagactcaagcagcttacttcattaggaatgattagaatgataatttttttttctttacaagaatactttttcttttagaagaagatatatttctcatttgctttaaatgttctatgactctgtttatagaacagagtcgtagaatctgttgctgaagagacccaacttcagctcagagaacacgccatggtctgtgccccactagcactggctaatgacagaaccacagcccaaacggcagcctggacacaggaaagggattcggtggaatgggcagaaactcctgaagtcatttcctgtcctctagaggtggagtcaaaatagagcctaaagagagtgtgctctccaggcctaagcacaaaggggtccggagagggaccttcatgtcccaaagggattcgggtgatgccaggcacatgctagtccatctttctgatggatatgcaaggagttctggaaacggattatgaggtggagacatggcttaccctttcagtgaatggttgagaaggattaaaggatgtcacatatataggtttgggataagtcttgacttctttcttctcccatggcctccccacaccccagcagaactatttaatgctaagttaaatgattcagaaatacaaatagtgcacactgcaaatgaggctcttctgacatctttacagctgtggccaaggaatctgtgggaacatgatcagggtatctcttctttgtgtggaacatggcagagaggcaatggctttgtgtatatgggatgctagaatgcacaccatgttttggaagaagagttagactaccttccttcagatttattcttggcaataaataacttacacgactttgttctcaaattataaaatatttaagaagtatcatttttctaaaacagatctgtgactttctacacttcctgttaacctttctgttaacctgggagtcaatatggttttgtttttttcttcatgcattttgacctttaaacttggagggatcttaaaaacaatccagttgaactacttatttttatgtatttgaaactgaaacacataaaagttaagggacttcataatcataaaaatgttgatctagaattcagtctttctgtgagcctgaccattgttaaagtggaattttccttgccagaagaaattatacttaaaatagaatctcgcaaatactaattctgaaagaatctatattttaagcacttaaattcatttcctgtgcaagacttcttttagtcaccttttagatatttacaatttgtgtaaaatagcattttaattataatataaaattattttcattatatatatagattataatgcttaaaacaaaacaaaatgtagcaaaaagtaggatttttgaacattaaagttgtgtggtacaattaaatcagcatttttatcattttaaagacaaaattaaacctttaaaatgaagagtaaaaatgattatctggataaaggccattgggaaggaattataaaagttttaaatagcataaggttgtacaacatatattggcaatttatgccccaacagtttttgcttatgcttaaagaattgttaaaggtgatttagctatattaaatataaaatataaatgtgtgatttttgtagtgtgcaacaaagagagattttatttgtttagtattaattacacactttccttttgttacttttagaatgtagatttttttttttttttttttgagacggagttttgcttttgttgcccagggtagagtacaatggatgtgatctcggctcacggcaacttctgcctcccaggttcaagtaattctcctgcctcagcctcccaagtaactgggattacaggcacccaccaccatagccggctaattttttgtatttagtagagatggagtttcaccatgttgctcgggctggtctcaaactcctgacctcaggtgatcctcctgcctcagcctcccaaagtgctgggattacaggcatgagccaccctgcccagctctagaatgtagatcttttacacgctgtatatacttccctaagttgtagaaacactttggcctcatatgacagaaagagactttgtgggttttcagctgcttttctttggcaaattgcatatggtgtgttgtggattatgctagaaaccttctcccatccactcacagatatgttgagcagttgtgtgtactgacccaaggagaaatgacaacaacaacaacaaaaagatttgtttccttccaagggattcacagtgtaataacgaaaaatagaatgtaggctgggtgcagtggctgacacctgtattccaagcatctttgggaggccaaggtgggtgggtggattgcttgaacacaggagttcaggccagcctgggcaacatggtgaaaccctgtctctacaggaaatacaaacattagccagatgtggtggtgtgcacctgtagtcccagctgcttgggaggctgagatggagggatgacttgagcccaggcaggaggcagaggctgcagtgagccgagatcacggcactgcactccagcctgggagacagaatgagaccaaaaaaaaaaaaaaaaaaaaaaaaaaaaaaaatatatatatatatatatatatatatatatatatatataaaaattatggtaactgtcaccgtggatggagagcatgacctggaatatagagttgcacatttggctgtgtataacagattaagcgacttccttactgatgtgcaaataggaccctttgatgactgcctcaaaaatatatataatcagaaaaattaaaaaaaattatagattcgaaaagttattttgaggctgaaatactttaaaaagaagaaagcactctgattatcaacgatgtgttgctcttttcctctggtgttaaaaataaaatattaagggaaccctattttctatttggttcttggaatcttaattagtaattttaatttacaagcagagatatatgacacttagagaattttattttcagttctaagaaaattgaagacatgttctgtctttttaaaaaaactagcatttttgtttaaagagagttaatatataaggaagaatcgtcaccgtttatgtgatcctgaattgctgacaattcataattatgaaataaaaataaataaaagaaaagaaaaatgaaatatgaaacagaagactaggtgagctctttctttaaaatgtttagaactccacgtgggaaaaacaattttcaaaaaccccagctaaattaacacatcaccacgtcttcgccacccaaatcagcacagaagttttcatgattttatttttcccgcagatgttcacattcgatataaagctgggacatgagaatctccacatagcacatctgtagggatagagttacaggttttacctctgaggcttctaggcttcaagcacactgtccaaaataaaagtagatacaagggctatgtttatggagagggtatcttttgtataatttcttgacatgtttctttttgtattcaagagtacaggcaaagcgatgttaactatgtgtctgtttttgtacattaaggttgttgctgtgggtctgaagcctcatacaagtattaaggaagttatggctgttttcttttcaattcagacttagctctgagttacgcactgcaggcgggtaccaaggtgaataaaaaatattcccagctcttatggctctgctagtccggagggagagagtcttaaaaactgataagtacaagtcaatatgatagtcagcaggaatggatagtcatccggcgggagtagcagagaaggtccaggatattgggatgtctgagctggaatgtgaaggggacatggtggaggacgatgggttggagaagctggcaggagcagcccataggaaatctcagctgcaagtttacgtggctttcagcttttgtccttgcttgacgagactccgttaaagagcaaaagagatacaatcccatctgtgttttagaaagcttgatctttccgtggcataatgaatgattggcacgcatcctgtctggaagacacgaattcttagtgggttatagcaatgtgtgtttgagggatatgaagacttccagaaatacagtgagaaacaagttttgcatgaaaacaggtattgaaaatacttaggaaacagagtccacagtctctcgtgaaagcaggtaaaaaggaagagataaatctgggatgacatatgttggtgggggacatgattgctgggagtatttggtgccactcagtgaaataaggaccatgtgagggaaaggaagcttcatgaaattgattttgacatttgtgcttcaggtccacggggcaagctgtccccagtagtgactctgaggctaagaaaagatggagttttaaaaattaccagtaatgaggcagtggattttaaattagtttaagatactggatgcttcatttgctttatcatatttgactttgtaacttttataaggaccaatcgaaatgaataaaattgtaattaaagaaagactatctgctgtaataaatttcaaactaggcagctctaccacaaaataaataacagtttagactctgacagtatctcacatttggtcaaaagtggttataaatcctgcaataaatcatagagaaggtcattgagataattgggaatgtaattactaatgcaaatgttaaaatattttaagacttccacgtccaacttaaaggtcatcatagttatttaattattttatttgaaaatttttatttgaaaactgtaaaaaaagaaaaataattttaaaaaatagcaaatatctctttgtggcattgggaacttaaaatctatattgatctattttaatattacattcatccttgagttgacattctatttttttctcaatgatttgaaaagcagtccgtttattcttacataaaataaatacaatttataaacttcctgaatgcataaaggacattcgttcttctcctttacaaaaatatctagaagaatatattcaaatagttactaaaatgcaacaggtaccttttagtaaatgagcaagatcaaacctggcacgttgagctcattctcttttaggccctccagctaccaatcttataaaccatgtggatgccactgtgtccctcggacccgggcaaaataccctgccccttgtagccatttggtaaacattttaaatttataaaatcactaatccatcactttctaagataaatatgggagaatatttttccttttaaagattatttagaattggcttttgttgtcttctattttaattcacttttttttgccaatgacattgtagacgcatcatatttttagagaaaaattactcggatttgaaattggaggatacattgtgagggccatccccctccaaagtagcccccaaaaggccagggagccctgatctccctaagcctactttctgccatgtaaaatagagattttgatatctacgtcccagaattattgagaggattcaataaataatataggataagccgtcagatattacatgcatgccaattatgattgttaggtcttgaaggggatttgggaggcacccactccaaacccatcccgaattgtggggttcaaagtggcaggccccaggccacaacccggacagagatcttcccaagaccccttgatggctcgcaattagcttctggattcagcaaataaaagtttcgctaccaattgtctgtgagtgagaagatggagccggcaaaatgtattttattggtttcagggaactccaggttgtttttctcactttgcttgaccttttaaattatttctctctgaaaatctctgttggttcttatcgaccttgataaagccaggcagatcttctgtcctcaggcttcatttcctgccttaaagcaagaaactctgccaagcagctgtttccattatcagcacactaatcttattcatcttgaggagaagcctgaattagaactgaaattctctgtattatctcaaagatccagttaaactggcacatcagagtgcactgctttcaagttccctggtcaaagagagagcaactcccaggcagctatttactttcaaggtctggttctcagagccttctatcagctgtggcttttgcttggagtggagtttgtctattgtttatttatgatttgctagcattttgcaggcaacaaagagtacaaaaaacagtctttctcacaaattacatgattaagcttctgtttttaaagtcaggccttttagatagagatagctgcctatattctgcttctacatagcatggccaaggacggaactggtgcaaagagctgggtggaggggacagaggatgcacgtggatatgtctgtgtgtatctcttcaatcgtcatagatgctgttgctcacagatgatgttaccagaaaaaaaaaatgcctcattatctcaggtgggatttaagctccagtctttcagattccaaaatcgaagccatttccattataccctgcattcacccccgaaacatgatgtttgcccacagagagggcatctttcagaggaaactgtccttttactttatacaaaatttttaaaacaacatcattctcaaatgttaggaggatatgttaggagacctggcataaatgaattaactgagatattttgtaaatcttaaaatccttcacttatgaacataaagagcataggtatttgagacttttatcttgatttttttatatgcatatctatttgcttctatttcattatcaatcttctcctctgttttgtgatattaatacaatatttccagacatttagatttcattagaaacttacatttaaataggaacttctgggattttaaatgtcaaatcacatgctatgatatgtatgtgtgagtatgcttgtgtctctctttatatatagacacacacttttatataggttgtaggcattatgtcagccagattgtaaattatcagaatgtgaatccacacagtccatatagctcaaactggccaactcccatcaagtatattgtaaaatgaggtttatcccagttgcccttgcttaaatctacctcacacaatcttaggggatttgaaaggagtgcttgggtacagtactgtgcagtgcagttgcagtcaggctcccgcaattgagtgatggattcctcccatccccagcatttgctggctctgtgaccctggacagggcaagtgacttcactgaagttctttatctgcaaatgggcataaaggtgctcccccccgttttgaaggactaaacgcaaatgttggcatgaaacctttatcatactgccagctaagaacaggagcccaacaaaaaaggaactcgcatgcagtcagacatgtctgcacccaggagtgtttttggtgcaaacctattggttggctgtcaagcagaatgttgttgaatgtcaaggcagcagtgtttaggtaactaagctggtaacatacttcccttcttgttcatggtagctgaaatcagacactggctctcttttcctgtaaagggccacgtagaccttcagtctttggggatcatatgcagtctcagtggcatattctttgtctttaagtttttcacaattaaaaacgatgtaaaagccatttttagcttgtgtataaaaacaggctgcaggctggtttcgacccacaggccatagtctgccaacccaggatcaaattaatcttccaagatcagactgaaacgcagagtccaacgccgtcaatatcagttactttctgcagtttgcaaattatatgtcaggcattttactgaagacatgtaattttgctctaccatgtgctaaaatccagcatgtttattcattaaattaaataacgcatttcctctgtccatgcttagcacacatcgagcatcccaaaacttcacctattctaactgtgtgaaatgtggctaataataaaagcagtattgtagtcagtggaagtgttcaaaaagggtaattttgtataatagtagtagtgatatgaagaccttgacctttctgcacaaggaactgtacaaaatatgcaaagtaataatattttataaaagaatcaagggtcctatgcataagagtggctaatagagatcaactatatatctcacacattttaaaaatgctataatggagtttaatgtgcttcgcgttgagaaataaacctgacatggaatactcaaaatatttcacaaagcaaacaaagggatcgtgtgaggataaaggaaacggaggcaaatggaagtggagatgaaaaagtcagcccagaactttccacttcagcaggaggaactttgaaaatgacagctcctaaatcagtaaaaggcaaagaggagtaaagacagtgaaatgccctgtgtgcagtttaagataccagctgacactgaaggataggttatggtctttcattgaagaggcacagcggcagcctctacctgtgaaagtgacagtttgaaaatgtcagtccctggcagaaagaagagcagctctgggggaaaatgtgtaggcaagccggggtcggggctgcagtgggtaaggccccgatgggcatgcaggcataagcctcaggctactggggaagttggctttccaaaattcttaaggtagagatagctgagacaggaaaaataagcaaacaattcaaaggaagtgactactacgttctggaggtggctggacctgccagccaggatgaggcttctgcccagagaccatcacagggagaatgagtgctttgctctgaggctggaaggcaggtgtttatgtccatgtagaccacatcgatgcagacagtgtgtgctttgcctgttttcccacctttgatgcactgttgttgaggtgtggagttgcttctcatcttctcatttcagggctcagtccccaggcagtctgctgtgtcttggggggacctaggcacccactgtggccttttgtccatgtcttggcatttcttactttgatttcctatttgtgcagctgtttagtcctccatgaccaatggttctcaccttgcaaagtttaaaaaatgcattcctgactcccagccctgcacgattctgatttggcaggctccaggaagtccggagtctctgctttcaaatacataccagacgtgcaggcacctaatgagcatgggtttaacacacatacctgggcacacatggatataggatggaaagaagtgcacttaggactccaaaaacagggaggaaggaaggacggtgagcaggggtgagggttgcctgttggatacaatgttcgctactcaggtgatgagtatgccagaagcccagtctccttcattatgtagtatatccaggtagcaaaatgcacatgtaccctcaatctaaaaaatcatatacccatatgagacaacacacttcttaaagaaaaggcagagattctgctgtaccttcgaatccccagcattttgcgcaaagcctgggccacagttgtcatcaatatgaatttatggagaaatgaatttggctcaaccatctcaccaatcctttctttcatgaggtttctaacataaacagtgttgctgggaggaaacagcttgaaattaggccagcggtggtgcagtcttcaacttttaaaaatagtgagagcagttatgggaatatcttccagcaatcggagcatctccggcatagcagagccacagagtcctgtgactgggcagtggcaccagagatagaaagtctgcaggttctgcctgctacttggtgtcatgggttgaattgagtcccctcaaaaaaagtacgttagagtcctaactgccagtaccttagaatgggactgtatttggagacagggtctttctttacagaggtgatggagttagtcattagggtgaaccctaatccaatgtggctggtgtcctcatacaaagaggaagttagcctgcagagacagaggtgcacagaggggcgaccatgcagggacacagcaagaagatgatgtctacacacaaaggagatagggtcaggcagaaccagccccgccgacacctgcggtgggacttccggcctccaggactgtgagaaaatccatttctgttgttctgtggtgtgttgttatggcagccctggcaaaagaatacagacacaaacttttaaaaataaacagtgacaacgtctttttttttttttcttttttttgagacggagtctcgctctgtcgcccaggctagagtgcagtggcgcgatctcggctcactgcaagctgcgcctcccaggttcatgccattctcctgcctcagcgtccctaggagctgggactacaggcgcccgccaccacgcccggctaattttttttttttttttgtatttttagtagagacagtgtttccccatgttacccaggatggtctcgatctcctgaccttgtgatccacccgccttggcctcccaaagtgctgagattacaggcatgagccaccgcgcccagccaatgtatttcttacttaatgtgtctgcagataaaaatacatttacatagtccagaaatataaaaggaagggacaaaaaaataagctgcaacccacaaaactgatataaagctattaggtttttgtcatacctctataaatgtattaggctgttcttactgtaaagaaatacatgaggctagcctggcatggtggtccatgcctgtcatcccagcactttgggaggcctaggtggacagaacagctgaggttgggagttcgagaccagcctgaccaacgtggaaaaaccctgtctctactaaaaatacaaaattagccaggcatggtggtgcatgcctgtaatcccagctacttgggaggctgaggcaggaaaatcacttgaatccaggaggtggaggttgtggtgagccgagatcacaccgttgcactccactgcagcctggatgacagggcgaaactccatctaaaaaaaaaaaaaaagaaagaaagaaaagaaaagaaaaagaaatacctgaggctgggtaatttataaagaaaagaggtttaattagctcacagtttctccggctggacaggaagtatggcagcatctgcttctggggaggcctcaggaaacttctaatcatggcagaaggtgaagggggatcaggcacatcgcctagcaaaagtaggagcaagagagagtgagaggggaggtgttacatgcttttaaacagctggatcttgcaagaactcactcactatcatgaggacagcaccaaaaggaaggtgctaagccattcatgagaaatccggccccatcatccaatcacctccctccaggccccacctccaacactgagaattacaattaaacatgagatttgagtggggacatagatacaaaccacatcagtaaacatatctattatatctataatctatgtctttatatcaattgaatgatatcacactttccatgatatggcatacacattattttatatccaaaaattataataaaatgccaaaaattctattctaaaatatatgtttgtatatttattgcaatttcaatgaccagttatgtcgtttctaactattagataaaatgcagacatgcatactcattcagaaacatctttgcactttcttccactcattgccacaggatacaatttcttgaaagtgaaatacaggcaatgaacagatgacatattgggttatcttgtcaaactgatcttcgggtaatccaaataggctgctccactacaggtgtgacggcttgcttctggaagcttctatgtttgaggagcctggtgaaggtagaatcctaagaggaggtggggtgaccgacgccctgggtagacagctccctatggacctgggggtgcggtggaccctcctcccgtgattgcgttatgttgttggcacagacacacttcaggaagggagaatgtgctcagattgtaggacctcaccagacgggctcttctaggggcagagttcttactggtcagagattgaaggcctgagaaagactggatgtgagggagagcctttgtagctgtcttggaagatgaagaaagacacagaacatggaacacagggcctctggacgctgagagcccacagccagtcaggaaacattcagctgcgcaaatgcaagaaacgtatttctgccaccacttgagtgatcttccaagtggattcttcccgcgcctccaggtgagaaagcagcccgctgccaccctcagggtgaggccacgcccgtacctgaactgcagaaatcgtgttggaataaatgtgtgctgttttgggcctctatgtgtggaataatttatgttgcaataaaaagaaatcattataattgccaatcttcttaattcttgcacatctaacagtcaaaatgaaacaaaaaaaatcactcattgtttccattttcattcatttgatcattactcagtagagaatactttttttttttggtaattttttgaccattatattttatatttttttaaagttcatgttctcatttttctttggttttattcaattttattgaaagttctttgtacaataatttattagccacttgtcagtcatatgtatttcaaatgtcttttatagtctatgaattgaaacatcttaatctttatgaactgtggcctagaaaagtcctctctattttctgttaaaattgatttatttttctaaagtttgaatgatttcatttatacatagagctactaattttctaatctgtagctttgcttcatttatacatgtaagtatttgcttcctattctagagtgaatctgtgttgatctcagtgtgatcctgttttaagatgtcaccctctcagatggctacccagttttctgagtgtcatttattaaatactttgctgggtaattattttcattattttctccactaatttttttttgctgatttaaaattccaactactttctatgttaaatcatctggtaggtgggtatctatttctggacatgctgttctttctgtttacatgcatgatttcctatgccaagtccatagtgctttaattgaaataacaataatatgttttcatatcaaatgcattcaagtcattttcctcactctatttgcaaagttttcatcagagacaataggacttttgtatttatttaagaactttagcatcattttaactaactttaagaaatagcactgggaatttgggagggttgcatttcatttttacaaaaaagagtggaaaaaattaattttatgattttatttttcattaggagaagagttgactggggagatttttccaagccaattttgtctattcttaatattatctgacacttgaaggcaaatactgggttttgcattactctgaattaacatgatatttatgttcccattaatactgaaaagtgggcaccacacacacacctatatatatacatcgaccagtattcagatattcggcaagctgtgctaaccaatacgatgctatgcactgaaatggaagaacctcatgccttcactccaagtggagatgaaaagttcagattcttggcatcgtttctctgccacatctgcttccctagtgctaattaaaattgggatactattaaaaggaggcccacaaatgaaacatctgagggtgttccaacagctctttaatttgggctggaaacccaggcacacatgcacataaacacctacgccaagaactgtgctcttccaagtattttgaccatgacatgacaagcttggtggaacattttctggttcatattaacataatattctttaaaataatacctccttggcatattgatttattctatgactggtttaaaaaaattctgaagcttgttcttagctatgcttttttagagggtgataattaattgttaaaatcttcattgttgattctaattcagagcatttgttttgtggattggtttgatatattcttcggttccatactcctagtttggtcagcttaatagagaaaatcattaattggactcttccatgtaaaagtttgtaaacaaaactttcgacctctaattgtaatagtttgaatctgtgcagacatagactccggaagaattgatctcagatgccctgagactcgagactttctgccattcactcttactcttgaacctttctgaggtactattgattttcttctaaaaaataacttagacgagcattgtatggaatgcattatccagaaaatcatttaccatgcttgttttctgttaatagaccagtggattatacatgcgcatttcttttactggaagggttgcttccaggtgtcatgaggagtaaaacagtagagatcaactgaggggcacaggagtttcaattatgtgcacatggtgcagtgttctgtgatagatgctgccttcataactggacaggtttggtgaccaaattataaatatatgaaatgacgtatttgcaatgaatccatggagtagagttcagatggactgtctgcatttaggctgttttgatgtcaggtgaattagtggctgtaatggtgttgatgaatggtagtttttttgctcacattttccaaaaagccttatgcattcaaatggaatgaatattgcatttatttttaaatttgaaaatcatgtgagaaataatccacttgaggttgaaaattactttggggcatatggcttgagtttctatttttaaaaatgtatgttagacatacattttatcattttattttttattttaagttctgggatacatgtgcagaatgtgcaggtttgttacataggcatacatgtgccatggtggtttgctgcatctgtcaactcaccatcttggttttaagccctgcattcattaggtatttgtcctaatgctctccctcctcttgctccccaccccgtgatgggccccggtgtgtgatgttcccttccctgtgtccatgtgttctcattgttcatctcccacttacattttaatgatcctttcagcatgaaattatatacatactaatatattttggatatttgtccctggccaaatctcatgttgaattgtaatgcccaatgctggaggtgggcctggaaagaggtgtttggatcaagcgggtggatccttcatggcttggtgctatcttcatgataataagtgtttttgagacctgggtgtgtggcatccccacccacctcttgctcctgttctggccctgtgacagtgtgacatggttattcccccttggccttctgccatgattaaaatctccctcaggtctccccaggagctgaacagatgccagcaccatgcttcctataaagcccacagaaccatgagccaatcaaacctctttttcttataaattacccagtctcaggtattgctttatagcaatgtaagaattgcctaatacagaaaattggtaccaaggagtgggacattgctataaagatacctggaaatgttgaagcagctttggaactgggtaacaggcagaggttgggaaggtttggaaacctcagaataagaaagggagataaaggaaagtttgtaaattcttagagactgggtaaatagttgtgacaaaaatgctaatggtgatataaacaatgaagaccaggctgatggggtctcagatggaaatgagaaacttcttgggaattggagcaaaggtcatgtgtgttatgccttagtgaagagcttggctgcatctttccccttccctagggatctgtggaactttgaacttcagaataatgagttgggtatctggttaaagaaatttcaaagcagcaaaacattcaagatgtggcctggctgctttatacagcctatgttcaaatacaggagcaaataaatgacttaaagttgaaatttacatttaagcaggaagcaatgcataaaagtttaaaaaatttgcaggctggccgtgtggcagaggaagaaaaaagctttttcagaagaggagttcaagaaggctgtggagcagctacttgttagagaaatttacatgactaaaagggagctaagtgctaatattccaaaacaatggggaaaaggccttgaaggtatttcagagacctttatggcagaccctcccatcagagacctagaatcctgggaggagaagatgattttgtgggccaggcccagggccctacggccctgtgaatcctcaggatgctgctttccgcatactggctgttctggctccatctttgaatcacaagtgcccaggtgcagctcagaccccgttccgaagggtgcaagccatacaccttgacagcttccgtgtggcgttaagcctgtaggtgcgcagaatgcaagaatgaagagtacctgatagcctctacctagattttggagtatgtatgaaaaaccctgggtatccaggcagaagcctgttgcaggtgcagagccctcacagagaacctctactagggcagtgccaagggaaatgtggggttgaaaccccatgcagagtctccaatggggcactgcttagtggagctgtgagaagggatcactgccctccagaccctgagaatggtagatctacaagcagtttgccccctcagcatgaaaaagccacaggcactcaactccagctgctgagatcagccttgggggctgctccctgcaaaaccacagaagcaaagctgcccaaggccttgcgaaaccaccccttgtagtggtgtgccctggatgtaagacagagtcaaaggaagttatttgggaggtttaagatttactgactgccctgctgggtgtcaaacttgaatggggcatgtaatccctttctttttctttttcttttttttttttcagacagagtctcactctgtcacccatgctggtgtgcagtggtgtgatcttggctcactgcaacctccaccttccagtttcaagtgagtctcctgccttagcctcccgagtagctgggattacagatgcctgccaccacacccagctaatttttgtatttttagtagcgacagggtgttcaccatgttggccaggctggtctcaagctcctgatctcgtgatccacctgcctcagcctaccaaagtgctgagattacaggtgtgagtcactgcgcccggcccagcccctttctcttggccaatttctccctattggaatgggaaagtttgcccaatacctatatctccattgtatcttggaagctacaaacttatttttgattttccaagttcataaatggaagggatttgccttgtctctccttgtctcagatgaggcttaatactggaatgagttatgaacttttggcttctgttgggaagacatgattttattttgcaatatgagaaggatatgagaattgggaggggtcaggggagaaataatatagtttggatatttgtccctgcccaaatctcgtgttgaattgtaatccccaatgctggaggtaatgtctggtgggagatgtttggatcatgggggtggatccctcacgacttattgctgtcttcatgatagtgagttctcacgagatctgttcagttaaaagtgtgtggcacttccccctcaactctgtcttgctcctcttctggccgtgtgagaagcctgctcccccttggccttctgccatgtttgaaagattcctaaggcctccccagaagccaagcagatgccagcaccttgtttcccgtacagcctgcagaaacatgagccaactaaatgtctttataaattacccagtctcaggtatttctttatagcaatgcgagaatggcctaatacacatgtgcatatgtatttatttattaatattatgtcattaatggaatttagaatgcaacagacttttccttagtttccatgatgtgaagtgtggggattttttgttagaagtcctgagtcttggagagtctaaaaaagtcatggttttctacacaaagtgagtggtaaattatgttaggtgaaaaagtgacatattctttgaagcctgtgggattcaacatactgcaaaaagaaaaaagaaaaaagaacatgagcaaatctatgaagaaagttttcacattttttagaaatgacaagaagaaaattaccacagagagaaatggtgaaaactacctgagacagtgtttgaacctctgttcaagccattttgaaaaatctgaaataattgaggcattagtgacacatgcagtgagatttcccttttggatagaaatataagggaaaaggcaaaccataaaatattttttattttatttattacaacaaaaagccattctgttattgggaaggaacacacacttcagagctggacatttggattagagtctggctttaccccttactagatgaactctggataaatcatctaatatttctggacaacagtgacccctgaaaatggagggtaataatattgactcatattgttagtatgagaattcagtaagataaattaggtaattacagcacatggaaccaaggatagaaaccataaagttgtaaaattattattattaaacattaatatttgatataaactataattgttaaaaccactcgtttattgtatatttcatatacaatctagttagtgaatataaatttttattatatgttaattgaagaatgttgatcaatgttattatatatttatatattatatactatatattatacattaatatggtgagaaggatggtgacattagagttgagctcactttagatcaggagtactggggtttaaattctgattctcagtttactgttaaatgtctgtgtggacctggagaaaatcattcaatgtttctgcttctgaaatgggacttgcttcagtaaaccaatataatctcctccaacttgaaagaagcatgagcctgcaaggaagctacagtggactatgatgagatggctatgcttggagtgcggggaggcatcgaggtcaaaagatgggcatttgaggcacaaaggaagtgagagcgtctggtaatgatttgtacatggtggaaatggtggaaaaacgtcacgataagagacagagtatcatggtatctcctgtctcacgcatggggcctgggaataacattgccacgcaccttgttggctgacactctcagacaggtcgagaggtgcatacgtggggtccattcattccgtagactgattgtattgacctcttgttctgtgccaggccccaggcttagcacctggcacaggctgagcgaaagagatgaggttgaaggaggggtggtaaatcagttaacctctgaaagcctttgtggattttcgtcagtctgtacctctttattagcaatttaattacacccatcaacttctcttaactagaagctcctacttagcctgatcaaagacactacaagtaataatttcatattaactgttaataactctgacacttcattccatgcatttttgaggccagaggaattgtggagaaatgagcttaaataagagtttccaattttctgtgtagctcagttttctgttctccgtggagtttccattaccatgcaattatcagaattggtaatctcccttatgaccagccttcagtctgtttggaatctacagagccatttgacaaatacgattgtgtcctgtgtttttaaaacaggtgattattgttttactaaagctattactctcttgtctgtctgtatttgaaattcctcagaaattaagacaaaatatcacaaggaagccatgattactcaagaattaaaggacccccagagtccacttcaaaatacatgtcgtcagttcattttacctgcatgcgtaatgaattcttgttggctgcagggtctgttcaaatgcgtaatggaaaagtcagcaagaagggagttctcatttgagttctgtcactgattctctgtatcttcatatgtgtgacttattctctgaccatgttgagcttcaaatagagctaaaactatgagattttcatggagtcatttatttgaatgaatctaaatctgttttaaataattactggagtttggatattgaaatgcttcatttcattagctgttgtagtagaaaagttaatgaagcggagtttaagtgccaagagaattgtacacgatgctagaaccagcagcccttggaagcagggacagacctcaataggcccgcactcctttgaattgtcctttggcaatttctctaattgccaatagacaatttttctgtaacctttggaaatatggttggaaagttggcccattattatgaatttttcatttaaatgactgaacagtcatttgccattgtgcttatagtttatttagtgctcggagaaagactctggctggcttagtgggtgataacctcaaagctgtagaaactacgctcttcactcattttcatttataatgagccagattttatggtttctgctacttgccttttatcactagggaatctagtttctcagctttgttaatacttttgatttatccatgcattttagtttatgcctaattttccttttatattttgagaaaatacttatcagatgctttgtaggctatctcctatctatcatctttctttctctgtcttcctgccaatcaacctagcgattgatcaatcaatctgtcattttttatctatcaatctatcttcctatcatcttcctatctttctatcttcctatcgatctgtgtatctatgtatctatcatctatcattttcctttctatataactatccatctgtgtatccatcttcctatcatcttcctatctctttatatatatctatcttcctattgtctatcatttttctatctatatctctctgtatgtatctatcttcctatcatctctctactgatttagcaatctatccatctacctttctatctttcttttgacctatttatctatccacttatctatgtatctatctttctatctgttgtctgtctgtctatctatctatctacctatctatctatctatctatgtatcatattccagtcttcctctctgtgtatgttcctatctttctatctactctatcatctgtcatttatctatcactatatatctttctttttatatatttttctttttgaaatttaatgatagacacattatttgcttatttatgaaatgaggatttccaggtttatttcttctttagatgtgcctgtgaagattctagtccaggtacatctgtttgtttactttttccattaagtaaaaagttagcctgacccactggagaaggaagcatgggcaaactcctccagccatgtttcccagtgcacatggaatagactcgttttcaaagttttgttctctaattttctcccttccacattgcttataccctgggaataaaaggaaaaaaaaagatttttggtccttgattctgaaactaagcccctaacttgtctttaatgcctactttattgagattttaagttggaatttgcttaacctcatgctggttatttctaaataatcagaatcacattttcggaaagaacccataaagcatttcttgcaaaaccatgtaaggatttgtaatggccaactttgagaaaatgcggggatgtttttattctcagcagctggtttgcttactgtagtcaacattcttatcaaccttccacgtttggatcatatgtttatttcttctttattttctgtgtttactattcttattaattgtattaatccattctcacactactagaaataactacctgagactgggtaatttatgaagaaaagaggcctaattgactcacagttctgtaggctgtacaggaaacgtggctgggaggcctcaggaaacttacaatcatggcagaaagcgaaggggaagcaagtcccttcttcacatggcagcaggagggagagagctaggggcgaaatgccacaggctttcaaaccatcagatctcctgagaactcactcaccatcatgagaacagctgccttcatgatccagtcacctcccaccaggccccgccaattcaacatgagatttgggcaggtacacaaatccaaatcatatctttaatatgtagccaaacttcagatcaatgttttgagaatttatcaggccttgaaagttcattttgttgaaaacgtattcagtaacctgtgtcctctaagaggcagcttgagctgtgcttgctgcttcatttcttcacctgtaaatgaaagagaatgaaaattgaaaagtactgattggctattgtgcagcaagacttaatgttccctatctaactttatcctaatgaccgtgcatctgtggcatatagttattatttttcatttttaagtgtacagttcagtggtgttaagtacattaacaaggttgtataatcatcaccactgtccatctctggtggactattctaacttgcaaaactgaaactctgcacatattaaacaagttcccattcctcctcctccagcccctacaagccatcattttactttgtctctctgaattcaactactctaggcacctcacataagtagaatcacatagtatttgtctttttatggcttcacttcgcatagtgtcttcaagatcatcatgttgtagcatgtggtgtgtcagaattcccttcctttttaagactgagtaataacccactgtgtgtagaggctacatttggtttagccattcatctcttggcagacacttcgattgctttcatattttagctattgtgaataatgctactagggacataactgtacaagtttttaatccttttgggtatttagccagaagtgcaatttctgcatcatatggtaattctatttttaattttttgaggaaccaccataggtcatcaacagtggctgtattgtttaacagtcctattgacagtacacaagggtttcaattttatcacatctttgtcagcactcattatttcctagtttttgctatcgtttttattcttattttgcagaaggtaaaactgaagctgaaataggttaagtcacttgttcattatcagagacaacatgtgcttctgggcttgactagtttaccagagtatgcccaacaagcccacttatcagggaggatgaggataggctccaaaatgcagattccctttgaaatcggccacaaagagcgtgcataaaatccttctgtaagtttttatgatacgagattgattaaatgcttagtgagcctgggactcttgggttccataggacattggtggttggcatccgaatcagagttttttatgacacacagcagtgtcactttacgttcctccagctttttttctctaggaattttctttttattgaataaatctttgttttatattccgaaaaaaagacagtttaaaaatgtttgtacctgtctcttttgaacaacactctaaaagtagatgggtaaaagtcagttacttgcacagctttggctgagcagccaatttacccctgagtaaacattctagaggctttatttgccaagccagagcctttcactgtaataattagctgtttatttgccaaccctattctgctgccttctttttcatagcttttttgtctgtttcaaattcataaatgcttttttttcttccttgggttatgaagtgctagatattttcaagaggattagaacatctaaagatacttctcgctcaatcctattatcctcaattttgcatttcatagctgctgggcttttttttttttaatgtgttttgttttgttgttgtttttaagtttgctttagtgtctgcaaaagccaagtcattagttccctctatggacattcattttcagacacacttttctttatcctttcaaacaaacggaagaatatttctgttgctggtgtttactccttggaaacacccgacatcgcaccacctacacatagtaaagaaaagcagtgtgaccagttctatccccgtgggtggagaggtggctccgtactgcacctcctctcttgctgttattttctatctcagccttcagcatggtattaatggtatattggatgatggctacatgtcaaataagatgtttcttggtgcctaattattccaagaaaatattttggaaatcaaagataagggaggaaaatagaaaaaaaagaaaggacccagaaatattcccattaatgctcaaattcaatgtggcctttgtattttcagaatcatatttgaaaatgtatttctaagtgattgattgaatgttgataggtggacattgaaaataacagtaaatatacatatggtgaaataagtcaggtgtagcccagagacagcacaggagagtaactgaaaggcaggcttcgtcatcagctactctgatatctgacccctcacagagccgtttactagtcataagaatgtgggtgatttgcataatgttctaatgcccacttttcttacaagtaataaaaaaaatagagtctatcttgtagggtgttaccaagattaaatgaagtaatgcaattagaaaaacttttcacaatggcagggaatttgtatttgatcaatgatgtcagatattatactgataaaggcagtaatgttgaaacatagagatttcgctataactttgtcatttctaccacctgtgtatatgactttctgagtcatggggtcagtgctttattgtatatggatcggtgctggttcgtgtaagctcaagatgtcatatgattgaggagacactgtcaacccctggccaactgtggattaagcttcacgtctcccagtgtttgctcgagtgcatcctaaattccattgacagtggcataaggggatatccacggtgcagagaaaacatttgatggtaaatgtcccgaacattctgatgaaaagtaaaaatattctttcatatttatttaggttttagctgaccttcatttaaaaaccagaaaaatgctttcttttacattaaatctgaaggaaaattattatttctcatgacaaaataataaatgtgactatttgctgctggcctagtagggtccagatgttttgctttgtaaactgtacatctgtcaaagaacccctgctgaggaggtatgggtgatttgtgttttgcaggtgaggaagcaaaggtttggatactttatatacattgtccgagtcataaacaaacagacaaataccaaactcagactttgctatgtctaaatctatgttctttcaagcatcctattctgtttctataacatattataaacattagtataaaataactatacaaatctttagttcctacacatatatgtgcatatttgatcatggtttcacaccattgttcactttgaggtaacaaacatgaagctgaaattgacagacacttcacagcatacccacagcatctctcctccggagagaggaatgccgtgtcatcacatggcaggaggcaggaggacaaaatggcatgactctgctccataaagcccttttatagggacacctaatcccattcacaaagaaagagctctcatgacctgatcaccttttaaatgccccacctcttaatactatcatattgaaaactgaattttggaggagatgcattcaaagcatgatgggggctatcacctgtatcagatttgaaatacctgattgtttccatagcacaagttgatggagaaagtgaaacatgaatttaagtctctgaaatcaaatttcaagtgcttgtaaaccaacttacaacaatcatgcctgtgagcaagtctaacttcctagccaagtaagtggtctgttctaatagtaattttttattatttaaaagttgttaatagacagtggctcatgcccataatcccagcactttgtgagacgaaggtgggtggatcacttgagttcaggagttcaaggagttcaggagttcaaggagttcaaggagttcaggagttcaagatcagtctggccaacatggtgaaaccctgtctgtactaaaaatacaaaaattagctaggcacagtggtgcacgcctgtaatcccagctactcaggaggctgagacaggagaatcgcttgaactcgggaggtggaggttagagtgagctgagatcacaccactgcactccagcctgggcgacagagtgagactcagaaaaaaaaaaaaaaaagttgttagtaatttttaggacaggctcaatgtatagtcttagctatgtaatctcacaatttgaataaggcatagaaagagccggaaagtactttattccagtttgcggtaaatgttagaaatacttcatggtcttcacttgctgcctgcccttccttctcagttccagacctaatacccactgcctaattgcagtacccactgtgcctcacgatcccactgctaagataaaactcctttctcccctgaatctacttgccctgaagtgaatcccgtttgagaaattagcatctcagtctatccaactgcttgaatcacttctctctcttgcttgcacataaagtctttcctgtgactcccacaccctgttggtcccagctactcagtgggtccaagtccatccacatctttcccctcccccagtccactctcctctctctcatgggctgccctactgggcttcctacgtctgccccactcaggaccctctctccgttcatctcctgatggcaaccagagggttttatcaggtcacaaatgagttggtgtcactgcccatcttcaaactctgaagggtgtcctgacgtgcctcctataagctacatgcctgtcacctgggccctgagtcgtgtgtcccctcctctcctctccagcttatcccacagcattttcgcttcacagcggctcacaaacagcccacatgacaatcatttctcgaaaactgttaactgagaggctgtcctgaggatgttgcttaaaaagcatgagttgttgcagagaaaagcagagaaaaagttgtgcagggaagggagtgcaaggatcaccttataaagacagaagccctcgtgtttttggtaaacgtttatcctggttttttaagggcactttttttttttttttgatgtctggggtgcctgcttcttatgttacttttaatatttttccttatttttttttagttcttaacaagccattattattaatagtcgtgctaaaatacgctttgatgggatggggagaccttcatttgcacttgcagcgtctcctatggtctcatccaatagtgaggagacacatgcggggaacaggattctcactttagcgcagggttagcggaaaaaaaaatcaccaacacatcctcctttccccaaacatgtcaacatccaacatcacaccttccttttaaagagagggctggttgttgagcaaagtgcattcagagaagcagcaaggggtagtaaacccttcagaatggaggaggaggtgggaggtccctgcagggtacttgaggcatttgtgtggatcctgctaggacactcagcaggggaattatatagcaggtgtttgtaaaccgtgtgtgggcaaaggcttagcagcctccctagggcatttaggatagtctaaatccttgctcctccgagaccacgcagcctgttagaaaagtagagtctcaaatctccccctcccccagatgtacttcatcaggatattagtgccatcagcatggcctggggataaggagcacattaatgtttgagaagttgtggcacaaacattctttctagaggcctggtatttattgcatggtaaatcgacaactgtgtattttttcctgtcttagcaccttatatgttgcgattaaaccatttgtcagcaattagcaccaaaaaggatcatgtttattgaaaaattaactagtgattgttttcgtgtatcaagaaagttggtaatgcaaattgtaatgattgcaaaatatttgtatatatttactgtctacccacaaatacgggtctaatattctggtttcatgggcctcagaatgcacagatctgttgaagcagcattgatatttatttttaaagtactagtaattttaagaagacaatgcacacggtaatttaatacagacaactatagaaagtgcagttatatataactttgtgaagcaatatttttatttaaataaatatttgctaaattacaaacagttgcacacaatagcactaccaatcagatgagaataggactcgctggttgaagccaattttctgctctagagtaggcttaaataggtgcagaataagaagaatatttggggtagaacggaagaacccagagaaaactaaggcaagaaagtgagaataagccgactgggcggcgtggatacttggcgagggtctgctggccaggcggtggaaagttacggagagtaggggaaggttttggtgaggtttgaagacaaaaaatgtagtttttgttcagtgtcgcgggaaataaggaaccactataaatttttaaactgaaaatgaaattatgaaaacttcagtgaagactaatctgatagatttaaaattgaaaatacataatcacaatagtccgggcatctttagtaatgggatgagaaagtctacctgaattcagcagaaccgttttgaggcctcagccttttaatgactattagacttggggaaaatgatataaaaaatgttagcatctgtaactttatctgtaagaaagtcgaataacgtttgtatctaataggcttgtagtgaaaattaagtaaaaaagcatgatgtgaaaacactataactataaaatcatgtataaaataagacataattacacatatgtacttatatatgttttctcagacatatagctataagtgtgtatacatatatatatacacaaacacacacacatacctgcaaatacacatatagttgatgattcccttaagttagtgtttcctaaggtgttttaatgaccctgattttgaatttaattatttgattataatcttactaaatatatacaaacataatgttttgcgtgcatatttgtatttgcaagttaaatgcatatttaacttacacaattcaaattgaggaaaataaccattaagatgatgatgtttttatgaaattcaattattacttgaaaaattatatatgatactcataggtatttaccacgtgtgtgtgtgtttgcgtgtaaaatgagtccatcttttcaacatttcttaccatataagcattatatggcttatatttgtggaagtttctgtatagtcacttattcttctcttgaagcaaacccatgatttctccattatctgtctctaatatttttctctttaggctgcaaaaaattaactgttatttcttggcccaacatgaacataaactcaaaaacaaatggcaggcactaatattgtatagtacaacctatgtagatagtaatctagaatattcttatattacaattttgattagcatttatatgtgtacatatatttatacttctatatacatatataattttaataaaaaattcttaaatactttggaaatacttgaaaatcctaacattcatatgtgtatacatatttaaagttatatatacatattcatataaatacgtatctttaataaaaaattcttacattggaaatacttaaaaatcctcagaaatcctcaggctggccaggcacagtggctcatgcttgtaatcccagcactttgggaggctgaggcaggaggatggcttgagcccaggagttcaagaccattctgggtaacatagtgggactcagtctctccaaaaaaatacaaaaaatagccaggcgtggtggcctgggcctgtagtccccagctactggggatgctgaggtgagaggatgggttgagttcaggagattgaggctgcagtgaacctggactgtgccactgcactgcagcctgagtgacagcgagaccttgtctcaaaaagaaaaaaagaaaaaaacagagaaacgttttaagcctgcggaaacaaagttaaccactatttgaaggatcttagatatccaaagaagaaatcccatgtggggtttgtggtattaaaggttcagacaacactggacgtctcttctacttacttttttgaaatcaaactgttacacctctcatgagatatgtaagtgaagtaagccatcttactacctaccaacttactctttgctctctttaataagtagataacagagagttaatccttgcaactaatatttttatttgcaaataaataagtaaaaattttatgtgtgtatgtgtaatacaaaacatattctgcctataacataattattagattttctgcgtataataatttgtcattgattgaatgcctatgtcgtgtggacagagggctcgcattttgtaaggatgatttcattgaaccctcctgattaccttttgacataggtcttaataacctgagcgtaagaagacaacgttcattaagtaagttagctgaagccacactgttattgagaggtacagcaagaactgactcagaagtctgagtttgaggcctgtgctcccaaacaaaatttaactttacaggatcaataaatgattattcgcctaagctgctgggacatataataataccttagtacaactaaagaaaaaacaactgaggaattttactctctttggatataccaaatgtaaggaaattctccaaactgtgaaagtttcttacattgccaatgctaattcgcatttttaaaaaaatagtgatctatggatgcctatcctatagcaatcatgcaaaattttgggaataaatgagagatgaatgaatactaaacttgagcaggaaactgtcttcatcccatgagcctgattttagtccataaggattatgctgtgtctccattaaatcagaagtgttataattctacttttgacccattgccaaccgttattttaaatctaccaaatagccttttgttaagacgcttaaggggctaaacactgtggttcaaaaccataaaaagattcccggttgttgatcaggcaacataaaatgggttgtcttaagacctgggcaagcaggggttcacttctcaaataagcatccagatgtaacagaaggggctataaagatcttctgctttggtctcccgagtatgaattgttttgtgatggggcttcatctgtgtttgtagaatgtcatctttcccatttcgtccgatagaaaaatgtcatttctttccctgctctgcccaaatgagaattttaaggaagctgaacactgcgcacattccagccagcgagtgggagaaaaattaaggcttgcgatcatgaacacgtgattttcagagtgaaatctgagagaaaatgatgaggaagctagatattggaacattgtgagatacagaaaagaaaggatgggtctctggcatttactgcattcaggaaattaagatgaatattttccacatgccaacagtcttcccacagatctgttgcttccacagagccaaagatgattatttattatttgaaatgctttgccccaaatgatgcctttatgtctgtggtttttcgttttccttctactgcaaatggattattgtagtatgccatacacacatgtactacacacatgtacacacacgtacacacgtgcgcacatggacacatgtacacacatgtaaatatgcatgtgcacacacacacacgcatgtgttttttgtttgtttttgagacagggccttgctctatcacccagtctggagtgcactggcataatttcagctcactgcaacctctgtctcctgggcttaagcagtccatccacctcagcctcctgagtagctgggacaacaggtgtgtgccaccacatctgcctaatttttgtatttttggtagagacagggtttcaccatgttgcccaggctaatgtagaactcctggactcaagcaatcctcccgcctcagcctcccaaagtgctgggattacaggcatgagccactgtgcccggcccacatgtatttttgatggttgcagtacctgatcatccatttaaacatgagacattttagagcttgaaatttccaggagtttggattttattggggaatacattttcttttacttctctggcaatttcccattgtatttatttaatattttggtaaagaagaaagaaccaatacagcaaaccaaggaactccaacaataccggagataacctgtgcttttgcagaagagagaatagtctcgtttgggagtcataagatttgctctctggccagaggttactaagtcattgtgtcaccttaggttagtcattttctttatatgtagaattatgtgtttatatacatttcttcatccagcccttcccgctctatcttgttacacagatattctcattagaatctacatgggaaaaatttgaactatctgaatttaaatccatggtgtgaacaatatctttaatactgattgagtaaaagaaggctctttatttagttaccatagaacttttcttttatgagtgcagctgaagtgggtacgtgattattgaaatgtcaccctctgcctgcttgttggcttcatgactgtcacatgtaatcgtttgagaatttttttcttgtcccatagtagatacatctggatcagacatagcaaatttaagaagaaagggtttacacagaattctccccaaatcttgttttttataaaacctcatctgcatgcatacctctttcttgcatggtctttcccgtgaaagcggtccacatccccactagatgctgccttctgccctgggaatcttccccgagtgcctcctctatcaattccttatgtcgtgttttcttgtaacagaacttcctggggctttagggaaaatgaattggggaaggggagaggaacaataaaaagggaagacttttcagagctgaggcggctgattcttaggaatttcgacaccaaagagtctacactgcaataagcattgtgatgataaagatgctgcttcatcccttcttctttctttccaatatgagatgaagttgagtgtgtgacattgtgctcccgtggccacaccctctgataaaatatgtcagactgcggctaagctgcatgagagtggtcagtcttatcttccagaaaaataattatgaagagcttttattctgacccattttccattgttcctcatttaacctttaatatacttaagattttgaaaatgtgtatacttatcccataccctagaaatagaattcatgctgggcatggtggctcacgcctgtaatcccagcactttgggaggctaaggtggacggatcacctgagtttgggagttggcaaccagcctggccaacataaatagtctgtactaaaaatagagaattagccagcatggtggtgtgcacctgtaatctcagctgcttgggaagctgaggcatgagaatcacttgatcacttgaacccaagaggtggaggctgcagtgagctgagatcgagtcattgcactccagcctgggagacagcacaaaactcttgtctccagaaaaaaaaaagaaagaaaaaaaaagaaatataattcacaattttaatgaaaaatggagtcaataataatgattaatcaatcaatggttttaatagctggaaaataatttctgtaagaataagcctacatttgtttcatttcttttcagctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagcgtaagtgttcaggggcatctgcccatctttgtgggtttaggtgggaactgaatgctttcgggagaagtccgggttcccacgttcagaggtcctctcccacaccttgtgaggatttggtgtctttcatcatagcaatattaaaaccaatgtatttcatataaaatattttcagccatttagaatgagctatgcactcttgaatgttaggtgaatcctaaatatagacagtatagacacgatgtaatttgcacatcacatcctattctgtgctgccattttcaatctggagggatgaaatctagaggaaattgagacattaagccctgcaataagactgtactcaagatgttaaaacataatgtaacacaatctttcctatttatcttccatataattttaagttctttgaagtcaaaagcagtgcctcatttatttgtgtatcacctgctctgcataacacatcgatgctcagtaaataaagcattaatttgatttgtgaagtggggtaagttttcgagaaagctatttacagtctatagtaataatcttaaaagagtaacaaattggagtactttctgaaactctagtcttatggaataatagtctgttatgcaaaacccaccagaagaatagttccactcacatacacactaaatttctacagcaagattttcattgcaggtatattaaaactagactcaaattggaaataatgtaacttcccaatttttctaagttaaaaactatataacatttctgtatagacaatgaatttttatggttctataatctttttcatttaatatatcatgtatgtctttacatgtcagtacatatagaatgatctcctttaaaaaaaaactttattttaggttcagggatacatgtgcaagtttgttatataggtgaactacgtgtcacaggggtttggtgtggagatagtttcctcagccaggtaataaccatagtacccaagagacagtctttgaatccttaccttcctcccaccctccaccctcccataggccccagtgtctgttgctgccttctttatgtctgtgtggactcaatgtttagctcccacttacaggagagaaaatgtgctatttggttttctgttcctgcattagttcacttggaataatgacctccagctccatccatgttgtaaaggacatgatctcactgtttttatggctgcatagtattccatgatgtgtatgcatcacatttgctgtatgcagtctaccactgatgggcatttgggttgattccatatctttgctattgtgaatagcgctgcagtgaacatacatgtgcatgtgtctttatggtagaacaatttatattcctttgggtatatacccagtaatgggattgctgggttgaatgagcattctattttaagttctttgagaaatcaccacactgctttccacaatggctgaactaatttacactcccaccagcagcatgcaagtgttcccttttctccactgcctcaccagtatctgctatttttttacttatttacaatgatatttttgcgccagtgatactagcagaaggattcacatagtcttcaataataaagtcagatcattggcttctttttgtctacagtattttggtcatgttaaaaattttaaactaacttatatccatatacttagatataaatagacaaacaattatggaaggcggttgagttcttcccaaaagcttttatttttctttatttcatcatttttattgcatttcctgagagtcagacaatattgaatcaacattagtatttcttggttattttctatttaagacggtactattttattgcaattaagtaatagtatgggaggctaggatagcaagatacattggtatgttttttgagttcagtcctaaacagaactattctctcaaaataggaacttaacagatggcaatatgtatatgtttggggttgattttaataagaacaatgtcccagacatttatggacaatgtttcttttgcacacagcctggaggtcattcataatgatgcctccatttttaaagtctgtatttcctgccaaatatttcaaatagcttatctacaaaactcataaaaaccctgaaaaactgggacacaaatgaggtgaaaactactaatttgcagatttgaagttggaattctactccctcttgttctaaatcctataccccttttataatgccagtggttctctactgggtatgcactgaaatactctagagagatttaaagtaaatgttaatgtccagttttgacccttagggattctgaggcaactggtcttaggtggagaccaatcatcagttttttttttttttttaagttctctaggtgttatgcataaaatgtcaagtatatgccatgttttaaaggaaaacccactttaaatttgtatactatctgagaaagacttgctaaatgacaaggtcactttataaaatgtaatttttattttcagagctttcgtttctttgtttgacagacgttgttctcgagagtagttttaggttcacagcaaaattgaatggaagacacagagatttcccataaaacacaccgtccgcaacatgtgcatacctccccactatcaacacctcacaccagagtggggtgcatgttacaatggatgcacctacattgacataccatcatcacccagagcccagcgttcacatgagagctcatttttggtgttgcaccatctgtgggcttggacaaatgtgtaatgacagggatccaccatgatagtatcacacttaaagtctcctttgcccacccattcacgcctaaagtgacttttgtggcccttaaagtctcctgtgctccacccattcacgccttcctgcatccaacccctgacaaacactgaccttgatctttcatctccatagttttacctttactagaatgtcatatattgggaatcatctggcacctagcctttcagattggcttctttcacttagtaataagcgtttaagtttcctccatgattttgcatggctctagctctcatttctttttagtactgaacaatattccattgtctgtatggaccatggcttatttacccgtttacgtacagacaacatctgggttgcttccaagttttacaattgtgaataaagctgctataaacatctgtgtgcaaggtttttatacagacataagtttttaacatatttgagtaaataccgaaggttgagattgatagagtgaatggtaagagtatttttagttttttaagaaaccatcagactatcttcaaagaagactgcaggattttgcattcccaccagcaatgagtgagagttcctgttgccccacgttgtcgcgagcatctggtgctatcagtgtctggattttggccattctcatagatgtgcagtagtatcttattattgctttaattagcaatactctgatgatgcatgatgtgcagcatcttttcatatgctcagttgccatctgtttgtcttttttcatgaggtgtctgttcaggccttttgcccatttttagccaggttgttaacttcctttttttttttttaagagttctttatatagtttagataccagttctttatcccatatgtcttttgcaaacccttttttcctagtctgtggctggtcttttcattttcttaatagtgtcttctgcagagctgaggactttaattttaatgaagttcaacatatctgttctttttaaaatgcatcctgcctctgtttttgtatctacaaagtcattaccaaacccaagggcaccacaattttctcctatgttatcttctaggagtttatatttttgaactttatatgtgggtgtgtgatacataatggattaatttttctgaagggcaaaaggtctgtgtctggattattttttagaatgtagatatccagtttttccagcaccatttattgaaaagattatctttactctcttgggttgtgtttgctcttctgctcgaagttcattgactagatttatgtgggtttatttctgggctctgtattctgttccattgacacatttgtctacttttttgccagtaacataatgtcttcttacctccgttttatttggctacgacagaatatgatgtatcggacactttttttcaaaatgtatttaatataatttggtaatttgtaaaattaattaaaataacatctcccagtttcctacaagatcggtcttgttggtcgcgaatatttatactgacctatttgattttaggtcagtgtcctgactgacatgggtactttcattacatttaaagctaaatagaaattgttttacctgaaaataattcagctctttgggtatcacagatacatcatctcagtgaaattttattgtaagcaatgatgtgttacccttagatttctttaaggatttctcgcacatgtgcctgttacttcacagattgacaaaatgaacaagaaccttcagtctatcaccgtcaagttgaggtgtttgtgaatacatccagaacagaatgccttcacggcataaacagaaactactttttatgtccctatgagccatatttctgtgtaaaggccacacatagctgggttgaggaattagacacactcaagtgttttcctctgcattgcaagctggtctctagaatgtccatgcaagtagtttatatctgccaaaaaagggattggcattacataaccctgaaataaagagccaactatgtgaaaattatgaggaaaagaaacacaatgtaggttttaagtcgttggttgggggtaaaggaagggagaagcagagagtttcgaaaagacgggagcaaacaaagtgccctggattccatcaggacagcatgtgagatggtgagttccatgggcacagcgaggcagagacattattggtacaggcaggagctgtgtactcgcaacccctcactgagcgtcctggagcgtgtgctctgaatggggcatcaggcttgtaactactggtgtgagactggtaagtgatatctcctgcccttagagcctgaagatatgcacaggacatgaaacagaaggccggatgcaaacagcagcggaaaagaataacggatgtagatgaaggaacacgggaatcgtctgggaccaatttctacagaagagatggctggggcgagaacttggcctggcaaaataggaggaaaatcagagcaactctttttttttttttttttttttttttgagagggagtcttatactgttgcctgggctgaagtgcagtggtgtgatctggatcttggtccactgcaacctccccctcctgggttcaagtgattctcctgcctcagtctcctgactagctgggattacaggcacccgccaccacacccagctaatttttgtatttttagaagagacagggtttcaccatgttggccaggctggtctcaaactcctgacttcatgattcacccgcctcggcctcccaaagtgccggcatcagccactgcgcctggcccagagcggctctttgaagagtcactctagacatttatctaagctacgtgattcaattagaatagcaatcctaggaagaagatattatgttccttatcttagtggtttaatacaaagaaaataacttgaggtatcaaagaatttgccatatgtgagcacacagatgtggctgggcatcacagaaacctctagggaagtgttggaagtcttcagctgctgcggggaaggctgcctggaaatgatttgattagacaccggtgctttgggcatcaggaaaaggcagcaattgtgtaacgctgccaaggcctgcctgggggtacactgtaccgtggtggagggagaattcaaggctctgtccattccagcagcctgtacatagagatagttcagtattcacctggtttcatgatccgtgggggcgaggatcaggagacatgatttgagcgcactgttagctctgaaatgtccacggaagggaataaaaagaagcagaggtgaagaaggtgggcagaagcctggtttggagccttaggacattcccagctacacactgtagggtggaaggaaccggaggaggcgtacaggtatctcctgtaacccttagctcctttcttgctctcacactcattccctcaccaagccctgcctctgaaacacatgcgtccacgtggcttcacttctgcaccacccaggtcaccacctgagcgcctgaaacccccgctgcctcacctccgcttcccttgtgtctccaaacaacagccagactgactttgtgagcatagcaatcaaaagaggacactcctctgcagaaaaactcctgagagttccatggcggtagaagaaaattcacaaacttctctttattttgagctcctttctccaaaagtaaaagtcaggtatgataaagaggccgacttggagccccacccacatcgtgtgtgagtccctgtgtgcataagtagggctacacaccatattggtaattactagcttaaaactaaccctataccccctactgtcttccactcttgcttccaatagctttacacaagttaatttacttaattattatgaggtatgtaatttcattatcaccatattgtatagaggaaaaccaaaagaaggcatgagttgagtaatttggtgaaggtcatggatacagtaagtagcaaagtccagaaaatcggagaagagaatctgtcttcctaatttctaggatatattgcttctaggaacttactagctctcatgatttttaaatctgatgcattataaaactgagaacacaagcaggaaacaggtgccactttaacattgcatgtggtttattctgagaagtattaagtaggtgatggggtcaccataggtaatagaccagtggctttaaggacaaggcctaattttctctaaaatcttctggaaaaatcaggaataaggggtctcttgcagttcacaggtaaatgtatcaatcaatagaacggttttgtgcctatgtaaaacatatgacagggcttaaggtagcttcacttatacctatttttttttgttttaaaatacatatctagatgtacaattgctttaaagaagttacaatgacaacaattaacaaaattgcttctcattgtaaagaagttattgcaggttccattaaatggttgttaaacagcaaaaagtcaatttgcatcgtgagtactcttttgataccaactatgatatgttcagtaacatgaggaaataaatgtaacgtttataataaaatggaaatccatgttaacattttctaagcatcatctgaaactttcaagtaagcatttcctcccgtcgttctttaaagtttgtaaaaaagagatgtggctgttttgttaaaattccttggtattcaagggctggaaaaccgatttaatttttattcgggggattgtttttgttcacttaatttaaatggaaaaaatctggcagagtaagcataaaactttacctcttagccagaaaaatttggttaccattaaatgtccaagtatgtatttccccagggctcattcctttgtatgatatgatggtatgaaacagtttttaagtttctttagcaattgcagtaatatgtagatcagtacactgaatctcaagagataaatacttcagctttgataaatagtaaatgcaaatggtaaatacaattagttcgtttcaccctcaggtttttagtaaaatgaaggttataataaggaattatgcttccatttgccgccttcttgcagtggtgcagatctccgaggcagatgtttgaggtcccttttttttttcatttcagttatttactgagactggatttggatcatcgaagacacgattcatgctaatgacatgatgaaagaagtgagggctattggtattaacggactgggtttaacagtctgacaaaatgatgaaagatgtgtatcatatactgtgtatttaggagaaaacaaaaccattaagctagccttccagtgaaaaactaaattgtttatttctctggtgtaagtgagcaaagtcactacaggattaaaatgtcttttctgggacaaagtaaagaacaacgtatacacatcttaaatgtggtaggtcacaaaagttagaatgcaatcaccttttcatgcaacaagaaaataaataaataaaaattaaatgctttacccaacatttggcattgattgacacatcagtagtgtcagcttcacatatgaaggacagtacagtctggttatttacaaatgctcactatgacatggtatttgggctaaagatacttagaatattataagtgtttcctttttgattaaaagaatataacataatcaacatcaagctgctatcataactcatctttagctgtggtacaccagagaaataaacagcttgcaatggaagaggattttagtgcttttttttcccctgaagtagacattaagctgctgttgtagagtgtttgcagctctttccaatatgtggagacatttttatttatgaatatttatacaaaaaaggaattctgtcaagatgacagctctatatcacttgagaatgacattatttaattagagaacaaattgcatttttttggtagtgcctgtccatacctcttgtcactgtttgccttataatgtgttttttgaattcactttgagctgacggttttgtccaaggtgttggatgaagagcacttgaaaataaactggtatgttgtttttcagttaataatatgtttaataaatgtgtgatttttgcatgaaaaaaacccctaagttctaatcacaatatgtgggtattgtttctttagctaaaactactactagtcagtgaagcaaagcagtcattaacaatttatttatgtggacctactctatgctgggcaccatgaggactttacatgattaaatgcaatttatatacatcataaaaaagggaaagcaaaccagagcaatactagcttgatactcatatctagtgataggtttatatcaccagttccatctagtcatatctagtatttataggtcatagaaacctatcgctatagtgacctatggtactatataatctgtatatatcgttatatgtatatcactttatatactatatatatcaccatagtgacctagtactgtaggtttacatgtactatattcgctatagtactatatgtacatataatcctacagtactaggtcatatctagtatttataggtcatagaaacctatcgctatagtgacctatggtactatataatctgtatatatcgctatatgtatatcactatatatatgtactatatatatatcaccatagtgacctagtactgtaggtttacatgtactatatgcattatagtactatatatacatataatcccacagtactaggtcatatctagtatttataggtcatagaaacctatcgctatagtgacctatggtactatataatctgtatatatcactatatgtatatcactatatatactatatatatatcaccatagtgaccttgtactgtaggtttccatatactatattcactatagtactctgtgtacgtataatcctgcagtactaggtcatatctagcactaggtttatacgacctataaatataaataactcaatgtagaaaaactaaggttatgtctatgagcaccaggcactgttttaatcattttacacgagttaaatctctgagctcttataacaaacctatgaagtactgctatcatgcccagagtatacatgggagcttgagtacctttcccaaggttgctcggttgctccatgatggagtcagcactgaagatggtccttttatgctcatccacagggttacccatgtggaactagcgtaaagtgcccgtcccgctttcagctgtgcttcgacgggattcccgtaagcaggtttacaaagtcaaacaaaggtcccatccccacctcatctaaatgcatcatcatcatgtgcagatgataaatacatttagaaaatacctattaaggtgataaaaggaaatgtctctgtgctagataggaggtacatatccacctctctcttctgaggctgtttgctacctgcttggaagaaataattcaggccaaaaggtcagtttggtaccttagctaaggagatgcacgagtctctgtgctagataggagggtgcatatccatccacctctctcttccaaggctgtttgctacatgcttggaagaaatagttcaggccaaaaagtcagtttggtatctcagctaaccagatgcatgagagacccctggagaattgtccccatcaccctcctgcctgggtggcttgggaacagagttggcaggtgctggaaaccattgtgtgatgatgagggaggcttgggttcccagtggcatgggagcccgcacaaagttgttaaggcttctgtgccttccagagctgatgtttcccagagatgaagggtggccaataatcactaacatattctgaaaccaagaggaccgtgatgtcaaaagacattttagaaatgagcataacgtttgcgtgattgtactgtactgctttaaagcactttacacccacagactgtcggctacatggggtttaccgccatttgatggctgccagaaagaagctgtgacaggctggcaaaaacgctgtgctgtgttgaactatgaagtttatcggtttataaaatagcagtggattggcatcctcatctttcatttaacagttctaaatgtatacttgagtaaagatgggaatattagcacacatttctatctatgtatgagtttttaaaattcacatttctacagatagatgtggtgctgttttctttgaaatgctacaagcatgtaacaaccaaaaatatttctacacagccaacacttacattgacatttcaaaagaaaaagaaataacctgatgctatggataatattacgcctagaaaaaatttaaatgttgctagaaaaaggttttcaaggtgtgtattttcatgttagcgccttttcaagcatatttatgatattacctgggattctttatgtttgggatcagagaacaagtaatacatataaaatagaagaatttgcttgttctatattaatataatgctgtaaagaaaacaagaaaaaatgcattttacgggatatatttttgctctgtagtacatatctatttaactgttaaaataatatttgagaattttctaaattatttgctttaaccctgtaaaatttcctttttattaagtccaaaaatgttgaatgacatcaatttcatgtaattcaaaattgtcaggagctctctaatatttttaagttctgctcagccattttcatgttggttaagaaaattattatttcttgtacagaaatattgataatttatttaccgatatgaagaaaaatgctttgcaatattaggcagagaaaaggaaacagaaatatgacactggaacttctgtagaaacattcaacacgttttaaaatgttcatgatgctgcaaacaatttccattaaatgttttatatgaaaatattactcagaaatattctaacagattattttcgacaaaacattcaaatcatctattaatttataatcttattattattattttgagctggagtctcactctgccacccaggctggagtgcagtggcacgatctcaactcgctctaacctctgtctctcgggttcaagcgattcttttgcctcagcctcccgagtggctgggattacaggcacacgccgccatgcccggctaatttttgtatttttagtagagacggggtttcatcatgttggccaggctggtcctgaactcctgacctcgtgatccacctgcctcgtcctcccaaagtgctgggattacaggcatgagccaccgtgcccggcccaatttgttatcattttgtatatacatatatatgtttatatgtttatatatatagatagatagatttcaatttgtaatcattttgtatatacatatatatatttctgttatatatatatatatatatatatatatttcaatgtgtatatgctatctacaccttgattttccctttcactcaataagagttaaaatccatttgagaaactaaagcttctccaagctatatattacttaatagtagccaggtgaagttaatatttttgatgggagtgtttggctgcattaacattttggtggtgatattagaaatgaggaaataaacagaacataaagtttggatgttcgttccttctttcaatctttccatcttctccaaattctagagcctgacttctcactctgaaattggaggaggaaaagtagaggtgagagagaggagagccttctggaccaatccataggagactccttttcacccctcagtggtctaaggacatctctgaggttggagtcactttctggattctcagtgaaacctgcttggaaactacccttcttttaagagaattccgtgctatgactatgtttattaaagccagattaatttttagaagaggaacacgtttggtttgatattggggacggcaaatctaatatgaatgctgatatttggcaaagcatgtatcagtgctaaacgagcttaatttttaaacgcaatctccttaaattaagtctaatctctgggttttaaggccgtgctgtaactcaagttgctatagacaggaaaatattttgaaagaccttaggcctgtgaaatgcctttctgaacccacatttcttaaaggttgtaaaatgcagacgaggtcatttagggcttataatctcaagaagtgcaaaatgcctcctcaggttagtacaagtggtggaagtttattgtcataatgtatgaggaagaaaataaggaggaaaggaaggaaggaaagaaggaaggaacgaaggagggaggaagggaaagaaggaagaattgaaagaaggaaggaggaaaggaaggaatgggaaggaaggaggaaaggaagaaaggagggaggaaggaagggagggagggagagaaggaaggaagggaagggggaaggaaggaaggaagaaaggaaagtaaaggaggaaggaaggaaggcggaaaggaagaaagaaaggaaaagaaggaagggagggagagaggaaggaagtaaggaaaagaaggaaggaagggtcaagaaatggtttcaggcacgggagtcagattttgcgggctgagaaggctagaagttgaaaattcaggacccttcactctgcaggaatctaggaatataccttcttgtaattcagcttcctgtgtctgcctcactcacacggtgtttacagcaatggccaaccacccactttctctaagtaccctttgctcccactctgctgcctgggttactttctgtctagatctcttctgcgaagatccaaagtactcaagagttgacctagtctgcttgtcgccatctattcttgtagaatttcttatcagtttacctaatctatatagtcaccagctcagatgccaactgctggtttttatggcttgtctccatgatgaagtttaagcctctatgtggctctggctgggttctcatggcactaactgtgccaaatccgtaatagcattaaggtttaaggtcgtcttcatcataatcaacaaattacgcttgagtatgtggatatattcttatttaaaatattgtaagaaaaaattttataattagggcaattaggaaagaatacttaagcgaatttttttttcagcaaagagctctaaggatattcttaatttgaggaattgtctaatacccagttcagcgttatatgcagtgcatggtaaaaccatgacctcgaaaagcaggcaacatgtgaaaccttataacatgtaaataaaaacaaaacaaataaccacaagaaaaattttaaggaacgttttagaagtaaataaggaaacaatcttttcaaagagagccaccagtaatataaatgctgtgtattgcttttacaattaagcccaacaagtcaaagaatggaacactaagatttttgactttaaatctatgcttggatcagtcatactatttttcaaaatccttcccaggggttggattagactcattttatgtaattaaaatatcaggcatttcatgaaatttaaaaagtagctttgatattgaactcaggtaataaagttgcaaaacttcaaaggcctatttgctggtatcactaactggatgaggtgaatttagtgttggtcttgtctcgctgagatcagattccatggctggtttgcctttaggctaccgatagcgttggaacactatttatttaacatggctatagttagttatttaaatattccaggatctaagtctgctcaaatatatgtattttaaaataaccatagtataaaaaataagaaagccgggccagagaaatatagatgcccgattttctgaaggttttagaagcttcacaaatggaaaaaacagtagtggcaggaataaggaaaagtctggtgattcgaaaccctaagaatatgacagtgttatgaaggtctagattcagttggaaatcttggggaagaagaagctagaacttaatgccttgagacctttttgtctaatgtttctaaaaagctagtcactctcaggtgagcccataaattacttcctagaagttaactttaaaactctattaattggtcatctactcttattctagataactcatttaggaatcatttcgttaagctgtaagggtaaagcaaaaatccaaaaacaacttttgtccttaagaatcccatatcctcttaccgtccgctccagcagccctactacggggcatctacccaaaagaagagaagtcactctgtggaaaagacacatgcacacccatgtttatagcagcacagtttgcaatagcaaagatatgaaatccacacagtgcccatcaaccaatgagtggataaagaaagtgcggtatagggaggccgaggcgggcggatcacgaggtcagaagatccagaccaccctggctaacacggtgaaaccccatctctactaaaaatacaaaaaaaaattagctgggcttggtggcgggcgcctgtagtcccagctactcgggaggctgaggcaggagaatggcgtgaacccaggaggcggagcttgcagtgagccgagatcccgccactgcactccagcctgggccacagagcgagactccgtctcaaaaaaacaaaaaaaagaaagtgtggtatatatgcactatgaaatactgctcagccataaaaaggaatgaaataatgtcttgtgcagggacttggatggagctggaggccattattctaagtgaagtaactcaggaatggaagaccaaatatcgttatgttctcacttttaagtgggagcccatctatagggatgcaaatgcataagaatgatacagtggactctggggactcaaggggatgatagataggaagatgggtgagggataaaagactacatattggatacagtgcacactgcttggatgacaggtgcactgaaatcccagaaatcacccctagataacttatccatgtaaccaaaaacgcttgtaccccaaaaagctattgaaataattttctaaaagccaaaaagaaaagaatcccatgttcttgattttgtcttggtggacgggttttttaagagaggattgttgaaattcgatggtatgaaacacatttaaaaggtcttagtatcctagttttccccaaaaactttatatttattttttacccaaaccaaagttgtcttgttatttaggcttctaaggtactagaactaacaccagtttttctctcgcgtgtccagtaagcacaggtttttagtgctagactgcacactttgctttagttgtgtgtatgaggaacagttatgaggctgattaaatcagtttactccaatgacatctaatcataattttataaatctcattaaatgtgcttcaattaaagttggttataagaagcacttacccacattgagtacgataggggagacttctctgttaagaaacaaaacaaagcaaaacaaaacaattgcatccagaatctaggggctgattagaatatcacagaagatttatgataagtttctgaaatttttgagagagaagggcaaagggctttatttatggtaatctcacttcccttgtctaaatatcttaaagcaatgtttattcttctatcctgtcactggctgaatgagtctataataaatcagaattactcacggccaaattaaaggctgatatttcttaagtaaaatgcaaagtattttgtgttgttgctgaaacactcacaagtcagggcaatgtgtcttttatgcacaggactatatattgtttatactttcaactgatctggatttgggaagcataatttaaggtttttagaacaaaaatgtgtcaaccatatcaacatagtcaatggtattaaccatgtcaaatattttgaaatgatctccagtaaatgttctcctgaatttgtgaaaattgaagaaaattattcctttatagttgttttctttaaggtaatagaaggtagcctgtatttccttaaaaataaaaaagaagaaatataaggtaaactggcaagttgaacaatgtctgtcatgccagctaaacccttatgtttttgaaaacatttaattttacaaaacttgacctggcaatttattcacttataattgttaaaaatattgatttataaagtttatattagcaaaacactttcttttgctacattttcccaggttgaccaaaattttaaaacattcaaggagtttgttattcatttgatatctgtatgctagtatgtttggagctcttgtcgattcaattcctgaaactatgcttggagttactcattttagtcatttgtagaataaatcaaattttcccgtattgtttctagtgttcagggaaagtgacaagtcagaaacacaacatgatgtgagacccacagatggaaattctggcttggttggggtgagcctgggcttccttgctcctctgtaacttgcaaataaatacaaataatagtgataccctccttttctgtctcagtgtcgttgtgagtgaggatccgcttacagtagaattacatatacaattacatacacaatgtgaaaagagctttttaaacagatgcgcgtctctgggagcagccgcgctctgcagtatctgcctatgatggtgggggactggggagtgctggcaggtacagggaacagccctgtatcttaggagagatctagctaagatatttttgttagaaagaaccaagtgttttctttaaaaatgtcagcacagaggtactcaggctgtttcgtgttgcctcctgactgtaactccactttgtcttaagtcttaggggaggcgtgcatgtttactgcaactgcctttgagtgttagggccatccctgggcagaaatgagagctcagtagaaagccgtttccgaggccctccttccctttctccacagtgccgctggctcacgctttgccttctgtgatgttcgagtcatatttttgctccagttcttaacttcagcttcatgtattctaccatcctctatatttctcagttttatcttattccctagtctataatgtttaatgtcatgaaatgaaaatgtccctatagactatatttttactctcttttcactttttcctctctaagtatgatattgtgggaagaaataacaaagtaagaacataacagaagcatcctagtcttcctaaataatcccttgttaaactattatgcattgatttttataaccttttgcatttatgtgtagtaggtatatattaaaatttatacatacatataaattacatatgtacatatatttatgtgtttttatgtgtttatatatgtaatgtgtgtttgtatacatatatatttgtacctcaagacagaagattttttcactgggacttagttgaactatttccagtttttcttgtaaacaaataaagtcctctcagctttcagtttttcagcctaactgtaaaatgatgtctgtgcctatcaggccactactcctaagtccctttgatctcttggttggctttttctctgaccattagtaatatatagaaaacctggaaactatggaaaacagttaaaaaaggacaaaaaagcatgggcgatttcatcagccagaaaccacatcaaatctttttcttcattccaactatttttcttctacctgttaagagaaaacttttgacacatgaaatttagcagagtttatttgagtaaataggtgtatcaatcaggcagccttcaaatccaggcaaggtccagagagctccacccagcaatgtgggcagcagcactgatagaaaaaggaaggcacatggggaggcagctggaggagccacgtctgggcacctgcccgactagggggtggtctgactagtctggggcccgcgatgggctgaagcaaggctgctgtgatgagctgagactcaactccttgttacaaccacatcctcttgagttgagttgcagtttgctgtgtactgagtgaggttgcagttcactgtgtaggaattcaaggtgtaaaggtaactcgaagccaaatttgtttatttatttttattttactttaagtttattttatttttattttactttaagttctgggaatcatgtgcagaacatacaggtttgttacataggtatacatgtgccatggtggtttgctgcacccgtcaacctgtcatctaggttttaaatcccgcgtggtttaagtatttgtcctaatgctctccctcctcttgtcccttacctcccgacaggccctggtgtgtgatgttcccctccctgtgtccatgtgttctcgttgttcaactcccacttataaatgagaacacgcggtgtttggttttctgttcccgtgttaaccgtcattctcagtgagccaaatttattttaacactacttgtcttgaggtctgaagtccacaatagcaatacaattgatactacagcttgtctctttctaacaatcagtagtgcatgaacaacaatgctttatctgtagcatcaattggtgtcttaccaataaaacattacttttgtgttgaatgtagattatcaacaattttatcatattgtttattcaatcaatggtatattaataggaaatttgcatctaaatcaaagagaatgttttcactgtgaaaatgtgtggtcacaggaaatttaaaaatcgaagtttggtacagttaagtgttatagattattcataaagaactttcaaaataaaatatctttaaattttttttatagaaactgtagcctagaattaatagttggaagagaacaaggaatgaaataaatttgttgaatttcttttaaatgaatattcagaagtgtcaagttgccgtggtattattctcttggacttgagtaaaagtggtattttatttaatggcacttttaccataatttgcatttcatatactggtaatgtcaatgacttaaacttatgaggaaaattttaaatttttaatgaagggtatataaagagatcagtgttttttaaaaatattcttttaagggtgtgcaagtgaaattttgcgccaaaactaagcatttgactctgaagtaaggtagaggttgaggatgcacagaagaggagaaaacatagggagttgggggggttgagtgtagacacctttgtgagagtgtatgtgacagggactgcaggaagacactgttttcaggcttctgatgtcagtgactagaaaccacgtacaggcatgtgaatcagtagactggggtaggtgtttgggggttgtaaaatgttctgtttttatttgaattcagtaccctctcgcgagagtcacagttctgttatcagatttttgccacattattttattggaccaagataaaggacattctttgggacagccttattgaccacagcaaatcagggcccaccattccgtgggggctgttggcactgtttttgtatgaacgcaggggtgcatggagacacaactgacaaagactgtaccttttctaccactctttagggaaaatggtctggcatcctcttggtttatattatttgggatttctcctcccaaattacgtcacagagtattcaaactcagttttttttgtatgttctctacctatcattcttaaaaaatattaaataaaatgataatttgcacaaatttctggaaatctccactcttccactctcatccttcagttaacaaaggacaagatggactttaatattaatatttattgcagtcctcacttttctttttactcctaatttccactcatacacgtttctttcctctctttcttttgttgtggcaatgtattttcttggcaggctatttttcaaagcatacacacatataattatattatgtgtatatatatatatatacacacacatacacacatatagtgtctaatttgtcagtcactatactaaaaaaatgtaaaaagacagtgtttacaataaatgagggtatagcatagccaaaaaaaaaaaagagagatgtgagcaaataatcaaactagcctaagataattacaaaccaaaccaaataccattttcatgaagaaagagatcatcatgaagaacttggaaattgatactgtagatggtatcagctcaaaaaattgtctgattccgttgtgtgaaccaaattggaatttttggctgggtgcagcggctcatacctgtaatcccagcactttgggaggctgagcatgaggatcacttgacccaagacttcaggaccagcgtgggccatataactagacctagtctgtataaaacaacaaggaaacaacaaagaaagaaagaaagaacaaagttgagtcattcttggcagaaataaagtttgtaaaagatagttcaagttattaaaaataatttttttttattattgttagactttaagttttagggtacatgtgcacaacgtgcaggtttgttacacatgtatacatgtgccatgctggtgtgctgcacccattaactcatcatttagcattaggtatatctcctagtgctagccctccaccctccccccaccccacaacagtccccagagtgtgatgttccccttcctgtgtccatgtgatcttgttgttcaattcccacctatgagtgagaacatgcggtgcatgtttttggtgaaattaaatgcattttatttgaaatatgcagtcagattcaagttgagttataaatttatgaggctaaaagcctttaagggcttttcagaaacagttttgctagaaattgtaagagtattttggctggagaaaaatattatttttatcattaggttaaacatttgaatcttcttataaatttagaataattccttcaacctaaaaaaatacttgagagaaagaaacctaaggattacttttaaattagcaatttttcttcccattttagacttcattgttactgttgtgatgatatcaaaaagagccacatttttctgtatatttttatatagtacttggaaattactgagaaaagactaatcaagatttttgtaaaattttggttatgcctgactcaattctaataaacttgtatagaatttgaatataggcttggtgtagtggctgattcctgtaatcccagcactttgggaggccaaggtgggtggatcgcttgaggtcaggagttcaagagcagcctggcccacgtggtgaaaccccatttctactaaaaatacaaaaattagctgggcatggtggtggacatctgtatccccatagtcccagcaacttgggaggctgaggcaggagaatcgcttgaacccgggaggtagagtttgcagtgagccgtgatcatgccactgccctccagcctggcagcctgggagacagagagcgagactttgtcacacacacaaaaaaagaatttaaaatataacactatgattctgaaaatagctatagtctctccagttaattcttcccagctcaataaattaatcaatttgatcaattttcttggtggttgattttaatgaatgatagctactaaatcttcgtaattagagaaatggttctggtttctaattttgtgtaatgtattttaaatcatcttgcacttttcaaagaatatgtacccacatacaactcagactctgtatatattttcagtatatttagaaagtccttgaagtccaccctggtaatagtatactactactgctactactgttgctgtcactattacaattgctactactctttcttaagtaactgctatattctaggcccttttctaaggacatgaatagatggtctcctttaagacttgttaaacatttttggaaacagtattagtgcagtatgcctatgtatttctgtgtgtttctacattcaatgatatatagatatattatatatgtgtgtttcataggtttgaagaaatgagggcatctgagtttctgaaaattagtgtcccagctggtttgcaattacacaattactattccaagttcctccaaggatattgagggaaattatatgtaagatttttatttgcatatgctcattaccctcatgaaaattttcatcaacttcaatgagccatatacttttgtggaagtgatttaccccctttacagttcagtctgactgcagacttcccaggacatctgtagtgaggcaattgaatgcattttacatatgggatcattcccatatgtctatgtgggtggtagagaaacactgagataatacgtaatggcatcaactttgccaaacaagatcagtttcatatagcaagaccttgccatccaaagcaagcacggtctgatgttttccaaaaaagaaaaatgatgatgtgatgtacgtttcccttccagcggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgaggtaagtgatgagggaggcacccctgaaagtcacggcatcctagattattctagatggcttatgtcagtggtgagcttctctagtggagctatcatctaccatagtcctatagatcaaaagaacaaatggcctgtcttttcattgcgatgtgaatatgtattgtcatgtgacatacttaaaccacattgctgctcgattaggcatttgatgttgtcttttccttgttaataattgtatttctccaactgtatttcaaatcagctcaaagacaaatacaaacctatgtgtaaaaagataactcttacgccatagacagactattcaagagttctaattgggatcttgggaaatagtatgaatgctgaagatattgtgttctcaaataaagactgttttcacaagggagatgattattctcttaggtacaagataagcagttaaagctttcagtgagtttcacattaaatatggtgaaatagaaaaataaaacaatgctagtattgttcagagcactctgaatcagatgtgtctagtatacaatctttacttgattgttcacagaaaattatcatgcataaaaacaagtagaatagtgtataatttataaaatacacagcttggtaagaatatgccagaataaaaattgaaaaagacaaaagcatgaatgtttaactgtctttgataataattttaattcaacttttaatagaacaaatgttaatgaaacacgtaccacaagctcttcaccaggaacacaaagataaatcaggaaggattgctggcctcagggagctcaaagctttcataatcgtaatgaacatggtccccgtttctctaagatagccctgcctgaagcctgttttccaggtgtttattagtgattgcttgtcactctgaacggtgtcctggtttggatgggtaatgacctggtcactgagtttgcagagccgttcctctttgtcacacctttgcagcttaggaaatgccccccttcccgacattcttgccagtcgtgcacagattttgtcacctggagattccagcattagcaccggtaaggagagattaggagaaggagtcaggaactctaaccttttgcctattttagactcttcccgccaacatcatcttgtcgatttcaaaccagaaataggatcttaaaaacagacacttattaatttcttccaggtggggttttacacagggcttctgcggctggcacagcgcagtacagcgttttcttgtctctctgatttcccagggatgcccacctacggtgtccctgtcttcccagagcagggccgtgccaaatggtatttgctgcgtgacaatcttccatgctcacaactcagcgttcccgaagaattttcacgtacagtggagagccttctccttaagggaatgttaacaaaaacctcattcctgaactaaactcattagtagcaaggcgttgacctcatcttgggaaagaaagcaaaggtagagctctgctgtccttgaacggtgtttctgcttccagcttctgaaattctagaaagtctgttttcctgcctctggttttatcaactgtattctggtgtttctgacacggagcggggtccagtcacaacccccacacatcatttatcatcacatgtctaggtgtctcgggccacaaatttgttttctaaattgtcagctgcctgctgcttgcgggctgggcacgagctgttctatcacactttgctatttgtcccttgaatgtcatcgtgtacacgtggcattttccagagtcactggattccagctgaaatcattgttgacttttaaaaaaatgattttattaatatctgtagctcaggttgtgacactttggccggggagtcccttttacacagctttttcatttggtccctctaacatctctgaaatggtccttgttttctcataaaaacaggatgttgtatggttatctggaatttttcttacccaaacacattgttctccaaaaagccctggtatcgtctggtggagaatggtatcagagaaccaattccacaccagggaatgcagtgtgctggggaaagctgacatggagtatattgttacttttgtgaccaaactgaaattttctgctttgtcttttttttccccccaaaaggcctgatgttgatattgtcaatttattcttatatctactatatatattttaaacatttaaaaaaattttttaaattgtactaatacagggcttgtcaatctttttttctctttttggagcataggtttgccgtcttagatgtcgtagtgtgtgactttttgtttaaattgggatgctggctaaaatttacaagccttaatggccgctttctcctctttttatctcttgcctcaatgttttggaaatgacatcagagtacagaagtctagaaacccctttaccaaggtcattcagcagaccctctatggaagggatagcccagcctctttgaaggcaactgttctcaggggttttcataaaatttttatttttaaaatttgaggacctgtgttagttattgattgctgcataactagtcaccacgtgctaagggcctcatgataacacagattcgctacggcccagcttctgggctcagatacctggcacattttggctggatcctctgctcacggtctcacagggcagagttcacggtgttgacagggctggaggcccggtgaggtccagtgaggtccagtgaggcccagtcaagcccagtgaggtccggtgaggtccagtgaagtcagtgaggtccagtcaggccccgtgaggctgagtgaggtccagtgaggtccagtgaggcccagtcaagcccagtgaggtccagtgaagtccactgaggtccagtcaggcccagtgaggcccagtgaagtccagtgaggtccagtcaggcccagtgaggccgagtgaggtccagtgaggtccagtgaggcccagtgggctccagtgggatccagcgaggtccagtgaggttcagatcagcttcccaaacctggctcctgggcagagttcatgtccttgtggtgtgtggctgaggacctgatgttattgctgctgctgatggggaaatactaagctcctggccctctgtcccccaccccaccaggccctctcctgagtccaatctctctgacttcaggaaggacttagttcctgataagggcttccctcaccaggctgttcccatccaaatcatctcattttttattaactcaaagtcagctgactcctaacatcctcagagttctgccctcactcagggggagaggatttgaggagatgtctcgactcaggggtgggacacgtagggaccaccttcgaattctgcctaccactggaccccaaagacctttttataactatatcatacattaaaaactattattattttaaaatattgatttgttaatttatttacactaaaacggatacaattttacgtattaatttaaaataacatatcaattacatgctcacataagtaacacatttttatgaacaataaggattcattttcaaacaaagcaaaaattaatgtgaagaatgtcatcattttaaaatttttcaaagccccttaatgtgtggcttaatacagggtggctggattctcagcaccttctgcattaactttgtcaaagtttgttgttttggtggagatatgtaaaataaaatatattgatggttggtagtgtagtcattggaaagggagatgcttgttgaccgctaaaagaatatcagagaagtccaggagttcttggatcccatttttagaagagctgtttcggaataacaccacacaatacacagtttcagaataacaccacacaatacacagtttcagaagaacaccacacaatacacggtttcagaataacaccacacaatacacggtttcagaataacaccacacaatacacagtttcagaataacaccacacaatacacggtatcagaataacagcacacaatacacggtttcagaataacaccagacaatacacagtttcagaataacaccacacaatacacagtttcagaataacaccacacaatacacggtatcagaataacaccacacaatacacagtttcagaataacaccacacaatacacggtatcagaataacaccacacaatacacagtttcagaataacaccacacaatacacagtttcagaataacaccacacaatacacagtttcagaataacaccacacaatacacagttttagaataacaccacacaatacagggtttcagaataacaccgcacaatacacggtttcagaataacaccacacaatacacagttttagaataacaccacacaatacacagttttagggcacgtgtatccaaggcacaggcaggcagtacacaaagcagtggagggaacagtacgaacaacagttgtcttgtgtttccctccaacatggattttcatgagtactagtgtcattatctatgtatgtttcacaaccagctttagtgcaatattcaatattcttgattttatttacttgggacaaatattgagttcctcaacatggtaaccatctactctcttgaaagtcacttaatagtatcagagaaaacacaggcaatgtggtggtgagaattacaccacctttaaaactttactcacccaaaagaaagtgaaaaacacaatttttaaaaacttaaaatgtaggctaggcatggtggctcatgcctataatcacaacactttgggaggccaaggcgagtggatcacctgaggtcaggagtttgagtccaacctggccaacatggtgaaaccctgtctctactaaaaaatacaaaaattagtcccgtgtggtggcatgtacctgtgatcccagctacttgggaggctgaggcaggagaatcgcttgaacccaggaggtggcagttgccgcgagctgaggtcccatcactgcaatctagcctgggcgacagagcaatactctgtccccaacctcccccactgccctccccccccaaaaaaaacctcaaaatgtaaacattatctgggatctacaagaaaaaaatcaataaacacattaattcattttttctgtaacacatttttatttcattctatgcttaaattacatttatctctcatgtttcctactttgcacacacatacacacacacacacaccacaccatgaatcctggtaataatataatttactattaaataagtgtgtgataaaccccaggaaattaaaacataatttaattccttaattaaaagtaatgaacatgacacatttttgtaaggccaattttccacactgtgctagcttcttcatagaagatacacagtgtcactctctatgttctgttggatcaggaccaacggaatcttcaagggtagcatcacccgagtcattggtgcaggtaaggagcagtcattttccttttttttttttttttgactccccagtgttcattttagagtggccctgcttgtaagatctcccagaaattaaatgttttcagttacttatttgcttaggagctggaaatagaatttccctttctgcttgtctaggtagctccagatgaagaggtgagccttgatcacctattaatcacattcatgacaactgtggaatccgctgagaaatttaccactttttgaagggtttgtgctgttctaactccaggctactttaatatgtccctagagaaaaactcaggtctccatgaatgaatggacaggagagcatagtcacccttaaacagtgagctctgcagtcctgtccttcaagaaacaataagagaaagttaaaattgaatatgtagaggcggctacacaccttcctagcacaaagtctttacacaagtagaaggctcttactcttgtcttattacatttatttattgttcgacttactgttcatatttaaaaagaaaaacatttatcacagaaatccctgaaccagaaaaaataatttttgcatttttaattttatacacacacactgactcagtgagctacactggaattttgtaatattgtagatattcaaagaacatggcctaaattctgggctgtctgtgtccgggctggtctttgaagatctgctgtttgttactggaggcaggcctggattgatcattaaacgtatgggagcctgtgtttatcagcagatgtatttcgtctatatccgaggaaaccacagcgtagtcattgtcatttcgttccattgctggagtggacattggacatcactcaggactacctgcagttgaattttcttgataatattctcacaagtcaatgcccagctaacatcaaataactgtagtgacagctcattgccccagagacagctgatttcatgtttgaacatttttactttgtgccaggcttcctatgtgacttatatccagtgattgatggtagctctatctctctaggcctaataaaacaattcctgactctgatctatacggagtgccttcgtgtatttgcaaacagccattgtgagtccactgagccttttattcatattaaagagcccctccctgctcacacattctcttgccagctgtttattcttcatggaggtctgcatgttcatttagcttttttttttttttttagctagaatgtatttgaaaagacctactcttgagtttatgtttatttgtcacactcacaagtaatattcatatttctgataggagtgctgtccttacaggtatgagaactgatatgtcacaatacaagtgttttttaaagttgatatatttcaacgtgaatataatcatagaattgaaggagagacaaaaaagagactttcctgtgggaacagaggctagtggcttggaatccccagggacagtgagaaaacacgctgtcgatgtgggattgcacgtgcattccggacgctgtgggattgcgggtgcattccggatgctgtgggattgcgggtgcattccggatgctgtgggattgcgggtgcattccggatgctgtgggattgcgggtgcattccggatgctctggatgtgggattgcgggtgcattccagatgctgtgggattgcgggtgtattccggatgctgtggggctgcgggtgcattccggatgctgtgggattgccggtgcattccggatgctgttggattgcaggtgcattctggatgctgtgggattgcgggtgtattccggatgctgtgggattgcgggtgtattccggatgctgtgggattgcgggtgcattccggatgctgtggatgtgggattgcaggtgcattctggatgctgtgggattgcaggtgcattcctgatgctgtgggattgcaggtgcattccagatgctgtgggatcgcaggtgctttccggatgctgtgggattgtgcattctggatgctgtgggattgcaggtgcattccggacgctgtgggattgcgggtgcattccggatgctgtgggattgcaggtgcattccggatgctgtgggattgcgggtgcattccagatgctatggatgtgggattgcaggtgcattccggatgctgtgggattgcaggtgcattccagatgctgcgggattgcaggtgcattccagatgctgtgggattgcaggtgcattccggacgctgtgggattgcaggtgcattccggaggctttgggattgcaggtgatttccggatgctgtcagccaagtgtcttttttgtgcaaagacttgctcccagagttcagaggaagcactgcggactgtgagcgtggacacacttttaatgaaatgaaaaaaaggcaaacgtaagcaattcatttttagaaacttcagaggaaaaagaacataaaaataaggctttcccttcggtgtatgacaaagcctatttttagtagtgaggggcttccccttttcagtcaggcaagatttccgagttattgctgctatctttattaatgcattgagtttactaccatacaaggaaactctgggtctgaaattctattattcagctactgaaaagctaaaattttgctccattacttcttctttacaattgagtaaatcttgttagaggacaaacttaaaatagttttgtcaccagaatatttttaacagaggcttcaacaatagaaacagccatacgagcagagggaggtggtcttgcttctctaccattgaaggcgaaggtgcgctgaaacctccaagaagaattcgactcagacctcattgttattttctggcaagcatggaagtttcaagacaagatccaattatcttaaattgctacaaatggatctttaaatatcatagttgaaggacaagttcaccctgtttgggaaaaggcttaatgaaaagtttataacaaattgtaaaaatctaaatcctactcgagttcattaacatttggtagagcaaacatattagcatattactaaatgcaaacgatatgacactgtaatagtttagcaatccccaaaaccaataaatcgtggaggctgtctcaataacaatagtgtgctggtcgtgatggactctcgagttggacctcccaatttctggtagtgcaccccacagaaaactcagtctgggtgtctctgtctgaacatttgagatagagcctcggttgtcctatcataacatggagtaaagacagcttaattaaaaggtctggggcttctgggaaggccaagatgggaggattcgcctgagcccaggagttccagacaagcctggacaacacaatgagacccccatctctacaaaaaataaattaaaaaaataaatagctgagcgtggtggtgcccatgcactaaggtacttgggaggctgagcagaaggatgtcttgaacccaggaggtcagggctgctgctgggagctacaattgtaccactgcaccctagcctgagtgacagagcaagactctgtctacataaacaacaacaaaagggctggttttagtggtacatgcatcactttattttcctcacttgaattatctctaaaggtttttctacttttggttcaattgactaaataggtcctgatttatactttcattgttagttaaccctgattaagcctgcttatgtgcgagggatggcttccgtttgaatctaatgcacaagcctatgcagtaggagctattatcaacccataacagggcccagagacttagaaaattggcaagtgctgcctggctcctgtctggcagaaccagaccctgggtagcctacagccagaatccgtgttcttcctcactgtgctttactgcctcttgtggtttactgtgaataaggaagaactcgatgtttgccactgcaggctgcagcgaagcaccctgcacatcagtgctcacctagcactcttaatgcttgctttgaatagcttttctaacactttcattcttacctgttcaaaacatatttcagcctctgatgataggttgggctggataaccttgtgagttcctccctcccctgagaggccatgatcttctgtgctcaagtgtttctgaatctgaagagcagagatttcagtggtgtagtaagaatatataatgagggtgaccattaacttgtttgccaaactggagtactttcatgagtgaaaatggacacgatcaataactgtgctaagacggcaggtgtaaacatggggcatagggtcaccccatcgacacccagttaaggtctagtttgtatgcacgttttagtttgtggaaagcctccaaatgccctgtgtagtcagcattcttacagagctcatgagcccaacaaattatgcaagtaactaaaaaaacaaataaactgagcactgctattgcattccgaagtcctagattttaataccacactactttgtcccagctgatgggctttggtgaagaaaattggtattccttatttcctgataggctcctgaggcttctggtaattactactatgtaattcttgggattgatatggaaagaaaggtagagagatagacaatttatttgattgacacgcttctgcatttatactttgtatactgtgtattttttcaagaatggttcagctatacctgtcaggatggtaataaaaataacattaatgggtcgaggcacagtggctcacgcctgtaatcccagcaatttgggaggctggggtgggaggatcacttgaggtcaggagtttgagatcagtctggccaacatggcaaaacactgtctctactaaaaatacaaaaattagcgggacatggtggcaggcgcctttaatcgcagctactcgggaggctgagggaggagaatcacttgaaccggggaggtagaggtagcagtgagccaggatagcgccactgcactccaacctggtcaacagagtaagactccatgccaacaacaacaacaaaagttaatgggtaattggaggaatctagaatgttttggaatccacgttaagcttttaggtttttgtttcaggagcataaagatggaaaattaagcttcttaagtgactggtctatccagccctaagcagacactctcaaccatgttcttagtgaaaattaagactaaaaatagttttttggttttttttgtttgtttttgtttgtttgtttggagcacaggagtaatctgcataactgaattgatgttcattttattgtttttccttctagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctgggtaaattcatctgtgttctggcacttacttaatgcagataaaccttagaaatagattacagctgtgtaacacatatgacttcttgctataatgccttaaatcctacctggggtggaaatgctgcacctcccagtgtgattttttctttgagtatctacagggatttgtttttaatccgagcaatgaatgaaagtcatatattgccttaagtgccataaaggcaatcttgcaagagtgctgagaatgtacctgcactcaaatgccatcatggttttaggacacacaaaaatgaatttcaaaaatattgtacattttatgtttttaaaaattttaaaattatgtcaatgaattgaagttatattcatccaaattgacataagtacagtgaattatttaaaatgctatatgtctacaataatgtagtcttcttttttcaaaaacttaaaatattctgcataatttaaaaaatggattgaaaaatgtttccattggaaaattctttgaataagtgtatgaaaaatcttgaataagcagtttaaagaacaagtattagtaaagagtgatcttagtaggtctgctggtgatttgtaaaataccttacttgcctttggttcttctgaaccttctccacgcgttcttcctttttttttttttttttttttttttttttaaatcactcaaagccatagaaactgggagctttaagcttctgaatctgcatgggcaaagatcacttcaggaactaagccaggcccagtaaacttcaaatagcaaaacctgttcttcttttcatttgggagaatttgaagaaacaagatgaaaggacagtagtaaccctagagaaaaaccaaccaccaaaaggaggttctcacacttgtctgtgaaacattatctacttattttaaatcactgcaggacttacaggaatgctgcttggtttctcacactctttctcactctgtctagtgtattatgtaatatatttagtgcattatatattattgaacacaattatatatatgagtgtgtgcatatgtgtctgtcgttgggtgtcctcattacagttttcagtagacgatgacatttccttggactatgtatgcttcttcatgtagagagtcacaagtccttctaggagtttccatgcattcctaaatatccttctgaaattggctatggaacagcactctcctttaggcagctttgatatggacaagctcttctgcctggagcttggtcctctgaaggagcccagttccactgggagggagctaggtggtccgagacactcacgtctgacagtatgtaccacatctctattagtaattgtaaacatgaaaattaacagcaacttacagttgattgctgctctactgcttacaaacatccgtaatctcatccttttggtcattaccaatacaggatgcaggaaaggccttcgttggtgctttgggagattaagtgatacattcagtttacataactgttaaatgatgggtcagcttggggattattgatccctgataagcctttatctatcttgtgttattcttgtgtctgaaagttagggttttggagtagaaaggatgagataaatgttgaatagttggctgcctggagatgcccccaaacatgtctcagtgctatgcaatacatcttagcagcttttgaaagatgattcactcagaaatgagtccatttgctcagaggaaaataaggaagaagaaaaatgcccaggttataatatataaaacatttgtgttgtagatattggatacagcatataaggaataataaaattggaagagacatagagtatttaaagggaaaaaatagaaaaagattagaaatgacacatacatatgtacatactaatgggtaaaccatgagtaattcatttagcacaaacattttgaaagttaataaatatagtttttgcagctaccactgtaacggaaagggttgagattcataacgtgtgaagcatggtaatgaagcatattcctttatcaaagacatcttttgctggggggcgacagcatgtgaaactcagcaagaacatatgtccacaagaaaccataaagttgcatgtgagactcagaggaaaatagggatgagtgagtaaaaaggtaggagaacagagatgatattgcttgagtagattgtatgactctaagatagatgaagggaacagaggctgcaatcctaaatctacacaaatatttagtagagtagcaaatggatacctccataatccaaatatcaactaggtgccatatttggaggcaggttataaatgatgatattttttgatgatttaaaatgcacatggcatttgtgagatttatctgattagaacgtacaggaagtgcttattccttcgacctgcagataagaaagaaagcatagagaagtacagaatttgcccaacatcataaaaccaagaatactatcatgctaattcagaccaataaggaggagtgtgttgtgttaactagaagtgaaatgagctctggaacctggattagtcccctctggaggcgcatgcaaggggcaggtgcaagggtctttgtgccttagttctgcctggctaattgtgtccttcatcctgtactgccaggatgctgacacgctctcgcctatcagtcttgctattgcttttcttccatctcttaacttgttatttgaattaaccctttccctgtttccatggttacggctcttttgaaaatcactttgggtttccaccaagttaaatgtccttgagtaaccttcaggctcatctggaccatgccggggtaaacgagatacttgtagtggggaaatgactgttactaaagatgcagttggtaaggagatatatatatatataatttcacaagacgccatgtgagtttgggtccttttttttgtttactattgttatgagatgggtattcataagtactattcagaagtgattctgaatcaaaatatatatatatattctgaaaactgtgtctatataatcatggcttcaactctaaaaatgatgaccccttgacaaaacaaaacaacccccaaaactatgactttaaaaagcaaatcatccaatcaggaaaaaatgggaaattacccaaacaaacagagacagctataccagattttctgcaagaaattcaattttcaagcaaagcaactgtcccaggacatgttgaagagaatgcaatgcgtttttaaagagagtgtccggagggacaaatccaccacaaactggaaatgatgtgaagggtgaggaaccccaagagagctgcctcagttatgcttgaaacaagaaccaaattcattcttgaaactggtatgaaaatggatgcttattcagttctgtttttttttttcattaagaagcttttaaaaacttttttaattttaatttttatggatacatattaggtgtttatatttgtggggcacatgagattttcgttacacacatacggtgtgtaataagcacatcatgaagaagctttattatggaatacacaggttaggaggtttttatttatttatttaattatgtttgagacagggtctcactgtgttacccaggctggagtgcagtggtgcaacaacagctcactgctacctcgacctcctggactcaagtgctcctcccacctcagcctcctaagtagcttggaccacagtgcacagcagcatgcccagctaactatttacaatttgttttgtaggtacagggtcttcctaaattgcccaggctggtcacgaactcctgggctcaagcaatcctcctgccttaggttcccaaagtgctgggattataggcgggacgtttttaaaatcagaaactggcacgccccaaagataaggagcttataaaagagaacttcagagttctcaatgaagttgtgtctcctgcccaggagaatttcatccgaatcagctgaggggactaaaaatcacactgctgagttactggcagtgttcttggtgagatattatggaaaggaagaatcctagagtgaaactcatatccagtgtgattgttctcacaacaggaaaagcaggaaaagaagctagctatcaaaaaccataaattgacttgatgatatatagagcagatacccaagcatattcttcataagtaactttggaaatgtattttcacatagaactaatatagtttccaagacaccatgtgagtttgcatccatttttttttgtttaatattgttatgagatggatattcataagtactattcagaaatgtttctgaatcaaaaattttattcctatcttcgatcagggcatagttgaaagagtgaaaataatattggatgatggattcaggatctcaaattctcacgataggacaaacaaaataatataatagaaattaatgtaaaatttttctcagagtagaaataaaataattgcaatgtatatgaggagaagaaattctgagttcatagtgtagaggcagagaacttgggagttttgggtaagagcaggctcatatgtgacaagtgctgccatgcaatgctcaggctgagtcttattaataaggttcttcccatcctctgttcgcccaggaatcccatatccagaatcatgacttcagttttttaatagtttaagtgggctcttgaggaattgctatgcatttgtggtgatggatctggtacctatgatctttgaggactgtttggaattttttttttttttttctgagatggagtctcagttgcccaggctgagtgcagtggtgtgatctcagctcactgcaacctccacctcctgggttcaagcaattgtcctgcctcaccctcctgagtagctgggattacaggcacccaccaccacacctggctaattttttgcatttttagtggagacggggttttaccatgttggccaggctggtctggaactcctgaccttgggtgatctgcccgccttggcctcccaaagtgctgggattacaggcgtgaggcaccacaccaggctggaaaatttttgatattactctgacagagagaaaagtaaagtagtcattcataactattttcaaatatttaaaatgctatcaggtgaaagatggaagaaactagttgtgggaagttgttttccatatcagtgccagccctgacgggtagagtcagcatgaagaccatgctgacatctgtacatcttaatcaggaacatgtgggtgggaaaaaagaaacaaacataaaattaattgcatatatctgccaagacaaggcccagggttgatgcagacatcatatgtgcatacttccattcatgggtttgtaatagcagtgtatttttctgttctcacgctgctaagaaagacatacctgagcctgggtaatttataaaggaaaggagtttaatgcactcacagttccacctggctggggaggcttcacaatcatggtggaaggtaaaggagaagcaaaggcacatcttacatggtgacaggcaagagagcgtgtgcaggggaactcccctttatgagaccattggatcttgtgagacttatttactaccatgagaacagaaactcccgcccccatgattcaattatctcttcctgtctccatccttgacaggtggggattattacaatttaaggtgagatttgggtggggacacagccaatcatatgaagcaggcactgtgtacagagaaagagagcttttggaatcagtataaaaaatccccacatcccctttcatttgtgtatttttaaacaggtggatcttccaaacaagacaactaagactttatgcaaaagcagggtccactttggttctttagattaacttcccttgggctgtataccttaggtccaatatgttttccatcctggtgcaagattttttgacaaaagcattttttttccctgaattgtggctgagatattttgtagtttatttttggggctactagaaagaatactgtttcctgagattgtgcttcagtttcatcgcaacatgactcatactgctggcatgctagttgtttccagtgacttccaacatgggagaatatgctggaatcctttttgagtattgcagctggagtggccaaacacaggaatggatgagcgttgacagactgagtcttgagaatgtcaactataggacagctgtatttaaggaaagaaaagatgattttctacacctaatattcaagaactcaatccatgctgtgttttaggtccctggtctggattctaagaagaaccttgtgagaaattggagtgtgcatgtaaatatcattgtaaatagattttgagcaaagtaatgcacaggtgcatccgagtacattagtataaaatttagcccaccttcatcaacacgatcactcctgcgttattactgggatctcccagagttcagagttctgtaaattgccaaggacctgctctaatttaccaactgtactgtgtaatgctacacctctccccaggccacagaattaagcactgagaatgctgacctggtatccactctctcaggcacttgctaatccacccaggaagtttgtgatctacatgatcccttaattattttctcctgtttatcttctctgcggtagtttgcttaaaccaacagagaacacacaaactaggaagaggttatagtttgtggtctaggtttcctgtcacagaatcccacattcatattttgaaaacatttacatcatttagacttttcagcacataagaacccatcctctctccactatgttacctcttcaatctctagtattcaagatattagtggtagcttgagttatttcccacatagaggacattatcattttttattagattgttttgctattgttagaaataagtttgcatttattgcgctattataaccatgaggagatgaattgttctgtaaatgcaatataatggttatttatgtggctaaaatagctagatgacatgattcaaaatactgtttttagactgtagttattcatagttcttagatagtcaagtttaaatatattcttcaattgccttgtattttggaaagatccacataaaatatttaataaaacaactgattatgataatgcttatatcacagcagagcagaaagattagcactgcctcccctgccccacccccatctttgccataccgtcttaagtgtaaaatatgttctgtatgttagtcaggaaaactccctataccagttctcagattttccaaatgcattgtcagtggctggggaataactagcaaacttctcagcggtgggtttttctgtcatatttctgaatagtatttaatgatatttttcttgttcctcaagaactatggtgcagcattcagaggttaataagattggttcttcttttatgaaatctatactctaaggagtaaataaggtaaataccaagtagctttaataaaaagttgagaataggcagggcgcggtggctcacgcctgtaatcccagcactttgggaggccgaggtgggcagatcacgaggtcaggagttccagaccagcctggccaacatagtgaaacctcatctctactactggacataatggtgggcaccagtaatcccagctacttgggaagctgaggcaggagaatcgcgtgaacccgggaggtggaggttgcagtgagccgagatcatgccattacactccagcctgagtgacagagcaaaatttcatctcaaaaaaaaaaaaaaagttgggaatagaataatggcaaaagggaaatataggcacattacttgagaaatccaggtgagagtgggagcaacctagaggctgacagaagagtagatgtgggggaagccgtgctgattctgggtggaattccagcaagcaggcatggggtaaagccattccagaaatcaagagctgcaaccctggtggcaacagcatagatgcggagtgcggcccaaggaagtcggacttgcctgaaacaagcaggtgctggggtcgaactctcgacggccgcctggtcataagagcctggactgatagggccacgagatggtggaaaagatctgataactctgacacccgctctagggcaggttttgagctgagtcctgatgcacatgcacaaggcatggtgctgcactcagaactcacagtccaataggggaagtgcataggtacgaaaaattagaatgccacctgctacatctaaaacaaaacacagtagaagagtaggagtctgggtgttttaaacaggcaacaccgaagataggctctcctattgtaggagaaacctgaagtcagggagatctttgcctcctgtatgaatgggcagctcttcctttggggtttgtggaagatgcgcacctgcggtggatttggactgaagtttgagggacagaaagacgtgacaccggcaggcaagactgcagacaaagcttgaggacaatgaggcaggataggcccagggaagaaggtggaaatggggtatattcaggaactacattgagacaggaatagataaaaagaatgctgaaagccccaaagacagtccaaatgatggccctggtttgaggttttcttcaaaccaaactggtttaaaaaagctgtcattcactaagatgtgtgaagcagagatctgatcaaatggatttgtggcagaggactcgggcccgtgtttgatgctgtcacaaacagcacagagtgttgtatgctctgcaagcccaatacctccatgttggacaaattccacacactctctgtgataccatatgcatatctatgcatgggctaagtcggtcagcattgcccctagagattgcacttggaggcaaaaaaaacacacctcagttatcaatattcaaatgtgtttctttagcatatggagatcaagagacttcaatatgtccgttgaagtgtactgctaataatagtttttcctgcctataagtgaatctgatgcacctgacattttatgaccatttgttaatactgaagaaaagtttgcaaattggctttggaatctactgcccaaataactctgacttagccaaagaccatgttattgcatagaatggatagaataaagcatattgtattcccctacaggcccaggatatttgtaatgtattttattttcagcaataagtaccagtaatcacaaagcaaatactgaggttgaatatttggtttatagattttctaaaaatggattccgttctaatccccggaccaatatttagtatttgtcctgctacaaacctgcacactgaagacgtgagcttcaagtaggcccctctaggggcaaaagtgcgtgtgtgggagacctggtgagaggggagagatcctacagctccaatggaaggagccgattcctccccaaagaatgcacggctccaggtctgtccgctgtcatgggagacattgtggcaacattcccactggtatatggggtttctgcgggagaagtgaaacagtggaactttattacatttccaaatcagggaacccatttccaaaatcacacaggtctaggtacttgtcggagactctcaccttgctgtacttgcatgtgaggtgttcactctgcgtgcgttatgatgtgaaggtaaatcggccaacaagtacctcaggtctctttgagggtccaccttgcgtcagtcactcagaaagtcaccactgacaatcagtgtggtggttttaggttgcaaaccgcataactcctttcagtagcaaaagcaagtgttgcagaaacagtacggatagctaaacaaagccaaatcctgtctgccagtaagattcctcctctaaaacacagctttgtagaaccgctttccagaaaacataggtcacccaggggggcatgctggagttctgaaggaaccggattcgttcaggagccagtttctgagtgttcactctactggaaacgaacaaacaaaacaaccttttgttctctcagcaaggtgttttataacttacactaaaagacctgtgcagtggaatttacatggaactctagaaacaaaggctttgagaggctggccttgcggaggcccctgctctcccgtgttgaattctataaactgcaggtgtgcagcctcccctggtctaagggtgggccacactgtgcgggtgataatggagtgagtggttttccctgtgtgtgtccctaatgaacctcagactcaactgacctcacaaagggaattcagccactttctgccctcctgactgctctggcacaaatgtagtttgcagggaaaccttgaccaatcaagaaattaggcctttcctccctctcgagccttcttcctgacattttgcttgcgacatactctatttctttgctatgaaaatggactcaatactccatccatcttgctaccagtctctgtgctttgttcaaatgtttggtagcttttatttatttcaaatccaattttagagaaagattgttaaaataactcccctttttctatttgagacattttaagcaaaatataatagcagtttataattacaaacagtaacaaagctttctttttttaagttttttttcttttattattatactttaagttttagggtacatgtgcacattgtgcaggttggttacatatgtatacatgtgccatgctggtgcactgcacccactaactcgtcatctagcattaggtatatctcccgatgctatccctcccccctccccccaccccacagcggtccccagagtgtgatgttccccttcctgtgtccatgtgatctcactgttcagttcccacctatgagtgagaatatgcggtgtttggttttttgttcttgcgatagtttactgagaatgatgatttccaatttcatccatgtccctacgaaggacacgaactcatcattttttatggctgcatagtattccatggtgtatatgtgccacattttcttaatccagtctatcatcgttggacatttgggttgcttccaagtctttgctattgtgaataatgccgcaataaacatacgtgtgcatgtgtctttatagcagcatgatttatagtcctttgggtatatacccagtaatgggatggctgggtcaaatggtatttctacttctagatccctgaggaatcgccacactgacttccacaatggttgaactagtttacagtcccaccaacagtgtagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattctgtaggttgcccgttcactctgatggtagtttcttttgctgtgcagaagctctttagtttaattagatcccatttgtcaattttgtcttttgttgccattgcttttggtgttttagacatgaagtctttgcccatgcctatgtcctgaatggtaatgcctaggttttcttctagggtttttatggttttaggtctaacgtttaagtctttaatccatcttgaattgatttttgtgtaagctgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgctttggtaccagtaccatgctgttttggttactgtagccttgtagtatagtttgaagtcaggtagtgtgatacctccagctttgttcttttggcttaggattgacttggtgattcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccgtttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctaggtatacaatcatgtcgtctgccaacaggggcaatttgacttcctcttttcctaattgaataccctttatttccttctcctgcctaattgccctggccagaacttccgacactatgttgaataggagtggtgagagagggcatccctgtcttgtgcccgttttcaaagggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctatcgagataatcatgtggtttttgtctttggctctgtttatatgctggattacatttattgatttgtgtaattgaaccagccttgcatcccagggatgaagcccacttgatcatggtggataagctttttgatgtgttgctggattcattttgccagtattttattgaggatttttgcatcaatgttcatcaaggatattggtctaaaattctcttttttggttgtgtttctgcccagctttggtatcaggatgatgctggcctcataaaatgagttagggaggattccgtctttttctattaattggaatagtttcagaaggaatggtaccagttcctccttggagtaacaaagctttcatcagacacagaatagagtagactgaaaagctagtgattttcaaagcttatggtacggaaactctttgtaactcaggaaagacgttcaaattcctgggtcccacccagggtactgcacagtccatacgtataacacctcaatggttctgaagtttcaccgtattattgttattgtttttattatcttttgagacagagtcttgctctgtcgtccaggctggagtgcagtggtgcaatctcggctcactgcaacctctgcctcccgggttcaagcaattcctctgcctcagcctcccgagcagctgggactacaggcatgtgccaccttgctcagctaatttttgtatttttagtagagatgggctttcaccatgttggccaggctggtctcgaactcctgacctcaggtgatccacctacctcagcatcccaaagtgctgggagtacaggcatgagccactgcgcctggccacggtattcttattccaatgacatattttgtagaacagtgtgtaaaacggagtcactggagcagaccatttcattcttggttccgttactggttctctcaaccattttaagtggttggtgaattaccctgtccacagtcatacctgttctcagcatggagaaaatgaagaattaaaatgtaaaattcatgaagtgtggtagtaattgaattgttaattcgtgcttgagctaaaagcaaattctgcaattccatgaggatatatttacattgtctatctatatacattggattaaaaatcatatgaatttacagttgcatagcattctttcctaattcttcaaccatttgcttctcagtcctgctgggttcagattactagtagactaataaattcacgcagaagattgatttaagagtaaagtgggtcacttgctttcttgccaaggttttccttccacactttaataggacaatttctgacacacacttctcaagaaatccaggcttcatgatgtccgagctgtgactgttgttgctacacaattgcctgttggagacattgggcagtttttgtttaaactgaagctaaacgtcaatgaataataaataaacaaagtctgcaaaatcaagacaaatcacagcctctgggctctggcatcatagtgtaaggtccactgaggaatttcagtattttattatcactagatgatatttggttttgaagtgtgcagggctgccctcaccccacgttcatttctttaaaaaaaaaattcagtgaatagagttgcttatcctcctttgctactgtgcatactcagtggagttgtagcaactatcttcaaatagtggcagagtcacgcagtggggctgacacctactatgtactaagctggacaggatgcaaatggtcaccctcctagcaaatgtataactgggtcatttgacatcatagtcttcatattttaacagatgctttaaaaatatataacatttctaatttctgtggctagaatgtcttgccatcaccttttcctggctaacaagcgctcatccttcagactttaaatgccacctctttcaccaggagtcctggtcctcagcatggctgagtgttccttccactcgttcccagcctgctaggtccgcacaccctcaggactctgcacgtgacagctgctcctctgcgtttaccctctgcgattgtgtcttattccttgtttaatccccagccccaagaacattgcaacccacaacaaatcatcatgaaattattgtcaaataaatgaattattgtcaaatacatgaaggtgacataggagacaatgtaaaggacatgactgcccagtggtgaggttattctgtttctgttcatttcaacaagtactcagtgtgtgactgatatggtagagacacagcagagaagcatgaacttgattacatttcatcctgagggaagacagagaggctttctaggttttgtgtagatgactcaaaaccaagactacatcagagatattaaaagaaaaggtaactcacatacaaagcatatagaataatactatcatagactaatagaatcttaaatttaaaatagagctcaaaattcattgagttcaaattcctcctaatgcaattttcccttcctcaacatattgacacaatatcattaagatttgggttaaagagtattctgtgagtgaaattgtgtggttatcctctatttgtaatagactataattggtcaaagattttgaatgttttaaaacagaattaacggatggctggaaagtgataacaggtgaaaaacagattgctatctcattgtttcaaaataggaagccacaatgaagaaataattgttctgtattaggaagcttagatactaggcaatcctgctgatacataacttttttttcttcaggcaaggaggtaaaatgaaatgtttttgaaggacatcctctgttttctttaggcatttggtgccaattcctcagagaaccgaaatgaccatgtgtcagagaggagttgctgttgggaatctttatttacagtcatggctgtcaggcttgctgcctgatttctagagtacacagatgcttccttgaccattacaagtccttgtttgccaggttcccaaagaagagtgcaacttcaaactatgtgcacttacaaaaaactcagttcagaaaaatattaaggtttaaaaggagtcctgtttgtctaagtcaagaatgagacctgaacagattccctaaaatgagaggagctctgttaaaatgcaccccttttcacatcactattgcctttggtcccacatcccctcctcttggagtggttccaggcttcagaagtaattccaaaaggaattgctggtgtcattttcttgtgtgtttctagaaactagctattctatgcctcgcctcagaaatggctgggatctcttgtgctgggctgatgggctcttctggctctcaccagtcctcgtctccctgtctctagggttggaacgatggctccatctcccccatgcacgacagagcacgttgtgcaaaggacagcgtctggaaaggggaaccttcagagacaatgtcctctgtgcctgtgataacacttgtgccttcagggggtctctcttcacaatatggagaacattcaccctcatcgacgttctccgcttgtatcaagtctcatatgtgggagtgattgggacaaatcaccagaactgacttattgatccgattgactggaatacctgccaatgcacaaaaattagccaaatctagcctggctttttgtggtctaatctcttctacgagttgaggcagagatcagattctcttctgtctctctcctctgcaatgttaccttcctgataataagtttgttctccaaaataggagaacacaatgtttctaaactttgttttaagcagaaatatagattatgattttaaatctccctagaaggatatacttaatcccaaaggagtatgacaacaattttgtaatttctcaaatctgggtgtgcaggaacttgtatggagaatcattggttgtgttccctgttggggaaataagtgggcagggaaagtctccgccttgatattttgcatggactgaaggcttctgtagctgttttcctacgaaaagtttctttctataacttcaaagataaatattgattattatttttagaatacgggtactctcactttattgcaaaattcctcttaaagcaattgtttttctaatatattctttattttcctgtgaattaagcaaaaagaaatgttgatgcaactataggagagtgacaaagatgattatttaggaactcatggtgaatgtttttcctcttcttgtgactccaaaacccatgtgtaacacaggtccaattcatgtaagttactcttcagcctgtatattttgttaatttaataagaataccctttccatatatgcgaggaagggagagagagaaaaggagaagttggaggaaaggaaagaaggaaaagtgagagcagtaaagaggcagaagagggagatggaagagaaggtaacaaaatgttgtggtggctcacacctgtcatcccagcactttgggaggccaaggcaggaggattgcttaagctcaggagttgaagaccagcctgaacaacataatgagaccccatctctactaaaaataataataataaaaaaattactcaggcatggcagcatgtaccatggtggcgtagtcccatctcctcaggaggctgaggccaaaagatgacttgagcccaagggattgaggctacggtgagccgtgatggtgccactgcattccagcttgagtgacagagcaagaccctgccaaaaaaaaaaagaaaaaaaatggtgggagtgagtggaataatgtcagagggtctgtctccatgtggaagctctgttactaaagctctttcaatgccatgtttgtcaattgttttactatctacatggacattctgtctccccttaagtaaagacgcctgtcgcgatctcgcgctccttcctgttctttcactgtgcacctgagtaagccctgccacctttagtttcagctgtcagctgtgcatgctcctgttgtcccaagtccacgctaacttcagcacatctgtccctggaactctagacttctcttttcaactgattccaggccatttttactcagacatcagctcacccataactcagattttcataattgaaattgaacttattctctgatccctgtctttccatttggaatttcacaggtaatttgattatctagtctatctgactggaagcccccctcaccgatctccttactacccataatcaataggttaagaagccctgttcatgttaattccaagaattccttctttactttttgctttgttttgaaaatagtataacaaggtaaataactgaatacaggtaagcaaaataagtgaaatggatagatgggaaaatcacaactaggaaaatacaaaccatttcatattagaaatattacttattttttccaggatttctgaaaaaaaataataaaaaaaagaaaaactatatttaaaagtatacatatatatgtaatgataaagatttcaatatgttgcgccttcaatactgttattgacttgataataaaagttgtgaatgtactacttttataaatgacagacactctaaattttaaaattggtttaacatttttagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccgtaagtgcactctttgtggacgaattcatcgatgcttccttttgccacattgtcttttgttattaggtcacaatatacacctgtttaatcttcactgtaaaagggaacagcaaactttcagttttgcctatacaaagaaagagaacaggagaggtgccatgttcacgctttccttttttgatctccttcccgttttgtttccttcaaactccttttcctgactccacatttaatttgcttatcaattcattgtaaatggatccctggccaagtggtgtcatggattcctcctccttgattttatcacaggataaactgggtggagagaaaagctgatagtaggagggtggaggtgcagagtctgggtctgctgggcagctttgcagtcctagaaacagcggcactccctgcctcatccgtgttgcatacatttttgtcattgcttcgtcaagaatatagggagttttgtaagcattctttcttttacttgaaagaggtaaaattggccaggcgtggtggctcacgcctgtaatcccagcactttgggaggctgaggcaggtggatcacctgaggtcaggagttcaagacgagcctggccgatggcaaaaccccatttctactaaaaatacaataattagcctggcatggtggcatacatctgtaatcccagctactaggaggggctgaagcaggagaattgcttgaaccctggagatggaggttgcagtgagcagagatcgtgccgctgcaccccagcctgggtgacagaccaagactctatctcaaaaaaaaaaaaaaaaaagggaaaaaaaagaaagaggtaaaattacatgtaatgaatgatcaaccttgagctgtataacttcagcgataaatattgtaaatattgactatttttcgaacaatgtactctcactttattgcccaatttcccttaaaccaattgtttttagaaatattgtatattttcctatgaagtagacaaaagaaatgtggataaaacagtgacaaagattatctgtaatagtgatgtgaaaaatgtacaaagttcacgggtaaaagctttacttataggaaaaaaattgttgacaagataaatgaggaagaaaacaccagttttatgactgtagtgtgtttctgttgaaagggtgaatgatggatatctctccctgatctgtcttgctgttatctggggcatgacatattgacagttcactgcatttcaaaggatcatatgacagagattctcaacaaaaataggagctgagtgtgcttagttattttgctaatttcatgatgtgtaaattgatattgcaataatttatacatggacattaaaaagtatcagacaaatcccatactgtctcaaaaggagggtttcacagagtcagctggtgtgtatggagaaaatgttcaaaactcatgattaatacaagaatttttagcatctcttgtttttcactgcttcgtttttaaatcatttggtattctgtcatgattcaagagagaaataataattatgatggtaaagaaagcgtgtttggcaggtgtttgttattttccacaattatattaaaagcctgtagtgtcagcctgtggttgtagctcccaatattcccttctgaatataaataccatctgtaagctgcctggttagtggaaaaccttcagtccataccgttagcatgcctgcatgtttcttattaataatcccaagggaaagtgatgacctgttcaatatttaacaatgacgttgacctgtctctctacagccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgaggtaggaacagcatccaggaatgagccctttgctctgagagtgttctaggctgcccagtaacaccatcaagagcctgtctccatgaatcaagggtaatgcataaagagttctgcaaactctcaccattcaggtgtgaaagcatttctgagagtaagcacaaagctctccatggctttttcctgtctcgtggccagatgttcaattacgaaaatctagaattatctcccttaaagataactcatcttctatttctctttttattcatgtatttacacatttatttctaccctgtatagttagcatttgggggccattatgcttctaattttatgactgtctttacgaagttcttactgttttaaattttcaattatttattttttgattcatttctttaaacgtagtcacagagacctctgctaaatctgagtttccaagaaaattgtgttcttttttgcatttctagatgtttgagctcatgatgtttaagatttcatttcaattactttccattacaacatcactcttattggtggtgtattgtactttagtgtgaagggcaagtattttttatggtattaagatgaaattgaagccaggaacttatcaatgtctctttctctgacaagaacctctcttatcctagggctcccacgggagctatcttcaaataagctgatagcagagtgggaacccaagtcatttaaaaaatgattagaagttgtatagaagttggctactcagctgcagagttctggctcaggtctaaattggaggtcttggcgtaagctcaaaggctaagtaaagactcctacctctgtttccccctaaaatactagtcactgtcaggatcagaatgcttgggttttgaccaacacactgatgaaacccagttcactcaactaaccacagtgcagaatgcaaaggaaaccagagtgagggggtgaagccagtgcccctgcctccgccgagccccagcccctgaccagaggagggaaccaccccagcttaagaagcccagggacattggtcagccccaggtgcacaggggtgagcttgcttcaatcacagctttcattgtatccaaacatggtctccctccaaaaataaaaacagagagaggaacatggttactgatttcacctgaactacaacttttcttcttctttcattgtatttgtgtttgttttttcctttaataattacatgggaaatatctgatgtgcagaattagggttgaaatgatctctttcactttagtttcacaatcacgagaaataagaggagatgcaaaacactgctgtgttctcattctagcataattcaatctttttggcagttgaactcttatgactgacaactgtgcagtggtgttttaggaagtatggagcagggcctagcaaaatatgctctggagctcaagagagctagcggtgactctttgtggaggccgcaggactccatacggagcagagctgagtttactgcacaggcctgatacttccagagtcaaacatgcctcaccctgccctcagctcctcacaatcgtgtgtgcgtgcattagcaatatgcttcatttctttacttaataacagcattatctcagtgaaaatctaacattggaggtcttgtgggtgattatcctgataagaagctgatctaatgtgtagtctctcattttaaaaaatatttcagctcaaatatgttaacattatgttttaacatggtaaattactaaattacgtgtttatatggaatatgtaaaatatgtcatatgttcagtatgttatttttttgttaggataaaatgtcatcaattctctctcttttttcccattaaagtcctccttttctctgttgaatgagtaaatacattcataataaaatgtttcattttgagataactgtagattcccaggcaggcactaggtataatacagagaggtcctttttgtcccctacccactctcacccagtggtagaatcttgcaaacttagagggtattagaccaaccagcatatggacattgatgtggtcaagatggagaatgtccattatcactagaatccgccttactccgcttataaacacacccacgcatcccaacctcattcttaattcctggtatccattaacctggtctccacttctctgaccttctcccttcaagaatgttatataaatgaatgaaatcatgtggtgtgcagccttctgagatgggccttttttattcaacataattttccggagattcatccaagttgtggcctgtgtcaataattcagtccctttttcctgtggagtagcatttcatggtacagatgtaacagtttttttcaccatttacccattgaaggacgtctgggttgattccagactttgctgtcacaaacaatgctgctacgagctgttatgaacacgattttgtgtggttataagttttcatttttctgggaaaaatgcccaagagtgtaaatggtactggcacatacggtatttgcaagtttagtcttataagaaactgccaagcatttttccagcatggcggtactatttgtcatccctacccaacatgtgtgggcgatgaagtttctctacatcctgtccagcattcggtgcggtcactctgtcttattttagctttcttgatagatgtgtggtgatagctttctgtggtgttcacttgcaatttcctgatggctaacgacgtgagtaccttatctggtgattattcccatctgtactcttcagtgaaatgtctgttcatgccttttgctcacatcctaatggaattgtttggatttttttgtttgctttttaagactgagtttcaagagttctttattctgtgtaatagtcatttgtcaggtatatgattcgcagaatttttcccagtctctcgtttgactttcatcctcttcacagggtcctttgagcagcacaagttttaaattcatcgtcttttctttttctgggtcatggtattgatgtcaagtctaagaactctgccaagacctagatcttgaagtgttcctctattttgtctatcactttgcatttgatatattttaaagtctgtgatccattttgtgttaatttttgtataaagtctgagatttaaatagagtttcactattctttttttaacctatggatattcaagagatattggttttaatatggtaatttattaaattacaaaggaacattatcaggaagggcttctatgtttctaacccaaaataaaaaaattaaaaattgaatgataaagatgtctataaataattttctgaattagattttttaattaattgatcctataaaaactttactgtgtgtttctatgtagctatactcactttccatataaagataaaacattgatggctttaatttctacatttaccacatatgagttgtttttcataaaagttttagtcttttagtcaaaaagcatccgttttcctctgtaaaacatggcagtggtatcacgtgagtgggcacgatggcgtgtggggaactggtgctcattttgggaactttccactgccccggctgagttgtccgcatgacatcagcacctgcgtcctcaccacagcagcaacaacagcaggtgcacacttctgtgtgtggggaaagaatccacccactgcaaggcaatgttactctgaaaatgctcatccatcaattccctttaattgtatgtctcgtagaatgacccaaattgaccatcagcaatcagtacacacgaggtcaactacttaggctacttctttggttgtttgaatgttgttttcttactttctttcttccttcttactttctttcttcttcttgcttttttttttttttttttttttttttgagatggagttttgctctgttgcccaggctggagtgcaatggcgccatctcagctcactgcaacttccgcctccagggttcaagtgaatctcctgcctcaacctctcaagtagctgggattgtgccaatatgtccagctaattttttttcttttttttttttttagtagggatggggtttcaccatgtgggtcaggctggtcttgaattcctgacctcaccaaagtgctgggattacaggagtgagccattgcacccagcctgttttcttactttcagaacaaccgttgacgataacatcacgagccttgtctgctttcttcaatgcaggggagtaactccaggccagattgaagtcataagggccgagacgggagctgtcttcattgtggcactcagtctacgtcctaaaactttagccacgctcgtcttttaaaacattagaaacaaaaccaagagcttccctttgtattttacactagaggattagatctatacgtcccgggagacctttgagtgcttccttcattttaatgaaaattcagctttattcttgcttttgatgaaaaaaagatggatccttctcaaataattggaagccgacttcctaaaaaatatttttaaagtagatccagttggcatctgggagacgctgagagttgggctgtgctttgcctctgcctcagtgccctgacactcctcttttgtaataggatcaggaaagtgatgccggacaggggcagacagtagccccctctgctgcagtttacaggatattggcaataaatgcattgaaggaggaaaatataaccttaccttcaacaagggggatgatttagaaaacccagacaggcaatccacacccatttgttgcttcaaattttggaaaagtgtctccaatttaaaaggacttcactaactagaagtggcctttatacattgttcttagttttaaaacgcacgtaaaatttcacataagtgtatataaagggaagcagtttttaatgagtaaaaaaaatctgctttgggattcacaagtactggatgaagctccaacacatgatattggacaatcctttctttcagtgtttattttattcttgagataaaattcatccaggcatagtgactcatgcttttagtcccagcactttgggaggctgaggcagggagatcacttgagtccaggagtttgagaccagcctgggcagcatagtaaaactcagtctctacaaaaattagccagctgcgatggtaggtacatgcccgtagttccacctacctaggaggctgagaagggaggatcccttgagcctgggaggtcaaggctacagtgagccaagacacggcacttccagcctgggcaacagagcaagaccccatctcaaaagaaaatcagatggcataaaactagacctagtttgctgggcatggtggctcacgcctatagtcacagcactttgggaggctgaggcgggcagatcacgaggtcaggagttcgagaccagcctgaccaacatggtgaaacccccctctctactaaaaatacaaaaaaattagccaggtgtggtggtgcacacctgtaatcccagctactcagaaggctgaggcaggagaattgcttgaatccagaaggcagaggttgcagtgagccaagatcacgccactgcactccagcctgactgacagagcgagacttcattaaaaaaaaaacagcaacaacaacaaagcaaatcaaaactcgacctagttaaccgttctaaagtgtgcagttcaggggcgctttcgccatgaccatgttgtgcaaccatcacctctgtctagttcccagatgtttcatcaccccaaaacaaaacgctaagcccataagcagtccccatttccctactcctctacctcccagcaatgagtgtggcatgtgtgcatgtgtgtgtgcatgtgtgtatgtatgtgtgcatgtgtgtgttcatgtgtgtgcatgtctgttcatgtgtgtgcatgtgtctgtgtgtgcatgcatatgtactattcatgcatgtgtttcttttaaatcatgtgaatgtaattaagataaatattgaaagaattgctatacatacacactaaaattttaagaagctggttgtttctcatatggaatatttaaatctgttatgtttatactgatttaacatatttttaagcatctgtacttgacagtagagtaggaaataacgtcaggttttcgctgtgtagtcaccttcttaaacgaaatttcctgtgacttttgtacccactgcttctttgtaataggtggaatttattaaaaacagccccattttccctctgtgactgtccatgactactgcagttctcagatgggaaatacagccatagaccaaatgctatttatgtatttaaacacaggaatactcttttctgaacatctattactttcacaacgtttgaatacttcagtgactcatattcactcgcatttttgcttttttttaaaaagggtatgtttcattaatcaattaattaacaagttttactttcaaaaatgtttgctcataaggaaatggcaattttgaaccacgtctgttgttaaaaaaattcaaattccaggttgttttttaaagaaatgttttctcttctctgagatttttcaaaagtcttaggataaggccatatctggccttttagaaaatgattctggtttcattttgatgaatataaacttttgtactttttattatttccatttaactcattgattgcattgccaaaaaaatctccaacagtgacagtttcattcgtagatgtatatttagtgtgttttagtccttaccctgttacagaaatttaaataatgtatataacctaaaagctctaaatttatcagagtgccatgtgtattaagaagtattttagcattgcgattttaagtggaagaacattgagtgtcttaatgtagtttctacataaagtaataaatacccttaatgacacaccctagaaataattggcctgttgaaggacaagacaataagaaaatcaccttttagatgatgtatattgtataaggctttgctgccaaaagatatgagcccaagtttatctgaattggtgtatctgcagcagcagtcaattcctattgctaatataccctatggaaagcaatctacaactgaagggaaaagatcacattgaaatgtgggaaaggcggtgaatgaagaaagaccagagcagttctgcgcttccctgggatgatgcctctgaccaataagctcagctaacagatgcgaagtttcaaactatctcatttgctcaataccttgcatagctctgggcccatgtgctgtaggtgaatacttctgaacaaatacatggggattatcatcgcttctcgctcttccagggtagagagcatcttacattcataacaaaatcctcaaagttactttgttctcactctccccagaaagcaggcttctattgtgtcttatttaggagggaggaggaatggaatcgctcacagaggtgtccctagtttcttgctcaaaacctcctgctttcgccgataatgtgggtggtctggtcagcttgaaaattagcaagtcgatcgtatagtctatataggattattatataataatgggttcgtagagagaggctcacttgtaaagtcaggggctatggaaaatgggggatgggtttaggggataccctgaaatgtgtcaaccggagctgaatgaaatcttgtcccactgtctctagcaccaggaggctttgctatacatgaaatatttattgcacactgtgctaaatatggctgaaacaatcacgttaactcattcagttctcagaggaatacatgaaatccgcacatctacaagaaactatgaggaccggaatggcgatgggaagacagatattagtgtcagcctcttgctcatgcagctgcaaggacttaaggaaagattcaacagctttaatcaaactcttttctcttccttgtgtgacagaaaataaattgcatgactgaaggaaccattgagaatgaatgtccacaaatgttgtcccagttacctccacacagggggacagcataattatgtcttcacgtcttaggtgtatcagaacattctgtatccatccccctagagccttctaggccatgcaatgccacatttgttgagcacctactatatcccaaatgatgtgctagacaccatcaatacaattattcgtgtctttaagtagataactatgcagacgaccagaggagtttgctagctaggaagactcacccaatctgccgtggcatctgtgcattggacacaaaacttgttcttgcagaatgagagattaactgaactcaaaagagtgggcttttaagtatgaaaagctttttttgtatgtaggttccactttcttctaatttatcccaaggaagagaagaagaaattaaaaacacctcatatttattcatcattctctgtatcccagatactgtctctggtccactagataccatgtctgttgcacagcttaaacaaattcgttgatgcattttaaactcttcaggattaatgtagcctttgttttttaaacttcttgccttttcctagaaaaatagaaacaaacttaattttaaaaactgctttttcaaatatatctgatgaagcaggggatggaggaggaggttaatggaccatcattggcatgtcatgttgattagaagtgcctggatcatccctagctgtctgcctgctttagttttctattattccattttgttttgttttgttttgttttatttcagaactaagattcaatctagtacacagaatttatatgcatgttattaaaacaggaaaaaacaatatttcaaagaggacagactcataaagatggtgaagcttcaggaaacaatggcataaaactcaaaaacctcaagttaaaaaaaagcagctgaacaaaattgccagggattcttgctgtttactgcaatatggtctgattcttactgtgtgtgctttttaaaatattctcacaagagttgtaggctgttgtatctcacataaatgtgctgttgtctttgcattcttttcctaactacttcctaagattctcaagtgtgtaatctggaggactcattgagtgtgaccctggtgcagcacttagttaatggcacaaaacagagaccccatcccacattttgaaacagagccccaggtaaatccgtgctactgtgaggcggaattagacacagatttctacaacatccacctcaccctgggtagcctgcttattctcaggttcaacccttcacaggatgcagctctatccagccctgcagtgcttgtgatcaattagaaaactcagatttaggagactaaagaaaattcattatactcaacccagtaacactatctttgcatataagattaaaaaataaataaaagaaggtatcccttttattagtagtagtatctttctggatgaaataatttatacagttgaagatgtcataagaaggaatgaaaacaagcatcttcaggtttattttgagaatcacattttcctactctcctggaggcccatatttccctagaggagctttcttggaaactttgtcccctattctaaactatgtgtcactatgcctaagagttgagccagttcagtgagggaccagttagatttaccaggtctcacatcgtttcaggatgattcacatactgtttccctgctttgtctaataatttgtgtattgcatgcaaacattaagatattgttttttcttttctttcataattttataggattgggtgtttagacacatgtaaaacatgtgtccagatatgcttatgtacataagcataaagaaaattaagaaaatatggggttagtgaatgttctgttagggtagaggaatcaaaaaggaaacaaccacaaaaacttcactaaagaatcattatgggtttagttgtactaaagtgttaatgaaaaatgggatataataacatattctcaaaatgttaaaatagtaaaattttaaaattaaaggaaatgtaagctaatgttaaaatagctaaaatagttattttaataactggggaaaataggttttaggaaaaatagctaacgcatgcggggcttaatacctaggtgatgggttcacaggtgcagccaacccccatggtacacatttacctatggaacaaacctgcacatcctgcacatgtatggcagaacttaaatgaaccaattgcagtgatgtgacttaacaaagctcctcttgggcttaaggaagtggatgggaaggagcttgtcaagagcaggaggttggtgtgagcccagggaccctgagactccagtctccccgaagctgcccttatgcgcgccgctggcagggtgtgtcccctggcacagagggaaacggtgatgaacccgcatcactcttgtgcttagggaaggcccctcttatgggggcattcatcctccgattttatgttaacttaaaagtcatgtgttcatttctcataatgcagtgtacattccttacagcaaaaattgtgagttatatccgaagagaagtactgtatcaatcatctttcaaaatagtagtgaataagctttgatttttagaaaaggtattgtagattttattgcattttatgtatttcttatatatatagaaatatacttctttatatatttcttatatatatttatgtatatattatatagaaagaaatatttctgtttcttatatacttatatatttcttatttatatatatgatgtatacacacataagcttacatataattcctatggactcttttataacctgcctttttgtgtaatcatatatcatgaagaatttttcatgtcaagaattatccttataaaattaatgcctctttaattaaaattttaatagctcagagagttaacttgcctttcttcttgacctgcaaatgctaaatgcccttaatataagctgtttattattttatcagtaaaatatgatagaaaaatacatccaaagcctggaaataatatagtcggagagaccattaagaattagttgtaactttgccttagggctgagttaaaatcagttaagagggaatgtacttgcaagagtctctgaagtcaagatgtaaatatgatggtgtagagaatttgcatatgccacttccttgtgttattaggtcgatgcaaaagtaattgcggtttttgctattgctgtagtaaaaaccgcaattacttttgcaccaaattaatatttcctgcaatgtttttcctttgcattaggcatattttctttggtaaaaaatgaactagagagccgggcgcggtggctcacgcctgtaatcccagcactttgggaggctgaggcaggcgaatcacgaggtcaggagatcaaaaccatcctggctaacagagtgaaaacccgtctctactaaaaatacaaaaaattagctgggcgtggtggtgggcacctgtagtcccacctactcgggagactgaggcaggagaatggtgtgaacccgggaggtgtagcttgcagtgagctgagatcgcgccattgcactccagcctgggtgagccagagtgagactctgtctcaaaaaaaataaaaaataaatgaactggggaaaatattaatatctgtgtaggccttagagggagtgttgctgagtagagaaaacacagtcttaggggttgatctgatatgtgtttgcacccacaccacctagtcctagctgcaggtcttacagttcatgctcgacttcctgggagaacagcagttttcttagatgaagaatcaaggaagtggtagccacagtaccctcttcataggtttttgagagctctagataaaccaatgcttggccaagtgcctggcagacagtgagtcctcagggaatctgaatttcctcttcaaagtttatattatcgcaggaaagtcaggcaatcaattacaattgtcaattacaataaattataacgtatttcttttatcacacctaaaagccaaaactatagctgtaacctggttatcagtccctccctcccttctttccttccttccttccttccttcttctatggagacggttttctccctccctccctctctccccttccgcttcccctttcccttcccctttcccttccccttccccttccccttccccttccccttcccttccctcccctccccttcccttcccttctttcttttcgatcacaatatgcaaagaatgtagaaggagcagttcagaagccactggggcctcctggagcacatttccggtttccttgtagaataaattgaaagtaccagacccgtccacctgttgctccgggcagctattgttaagacaaagcaacttcttaaggccttgcctgatttcccactgagctccttgagtgaagctgagtcaccctctcctatgactttcttccttgtatgtcaatcagttgacaatgtttgtttgaacagtgccctttaaactttatcagttatacttcattgaatattttttttaagaaaagtaaaatttcagaagaaaactataaggagtattgcctatatattgcctatgcattgtgtaatttagtgactttgtatagaacctttgtaaggaaagtggtgaaacagtgtagcagtatcacaccagtctcctccctcacgtggtgaaacagtgtagcagtatcacaccagtctcctccctcacgtggtgaagcagtgtagcagtatcacaccacagtctcctgcctcacgtggtgaaacagtgtagcagtatcacaccacagtctcctccctcacttacatgtggaaatatcatgtgttttgcgtgttcctgaactaggcagaagctagtgatacaggcatgatggggccacaggattctttttgaaaacaaaataaagctttgaacatggtatatttccagtctgcttacagaattaaggtttctatattctgtacacaatttttgtgacataaaaattgtgtcacagtttatattgggacgtatattgattttgagtcgctttgaggccaatgatggtcttaaaataatggtttttctgccaaaattttaagctcaggtctgatttgttccagtatctgttcagagttaactgttaacttaaaattcaaacttaaagaagttatactttaaaacattttcaatgtattttttaagttgggtatgtaaacctcttgtccaggtgatgtgtagtcaaacgtgttggattaaatacgtgcataaatatgtgtgagttaaaaaacaccaacagaatctgaagtcgatggtggtatggacgattgaaaagtttattacctccaaacccatgtgctttgcacgggatgctgggcttgttgggattcctgacttcctagacccaaaattaccactatgtgtctctgacaacttctatttgctcatcttcgctggccgttcatccagcactcatgaagtaaaagaatgaggcgaggcgcggtggctcatgcctgtaatcccagcactttgggagcccaaggtgggtggatcacgaggtcaggagttcaagaccagcctgaccaatatggtgaaaccctgtctgtactaaaaatacaaaaattagccgagcatggtggcggatgcctgtaatcacagctattcaggaggctgagacaggagaatctcttgaaccagggaggcggaggttgcagtgagccaagataatgccactgcactccagcctgggcaacagagcaagacgtggtctcgggggaaaaaagaaaaagtaaataaatagcctcaacgcacaggtttctttaaatcccatgctcctcccagcatcctacctctccctcctgtgcgtttgctcggctcccagtcactgctgttgagggttgccccagtgagcagaatttgacagacgtggatcagacgtttcctgtgaatccgatttgaggcagcgacataaacggatggtctctcagtgcacctccaaatgtatggaaagttagttgccttttattctcagaatgtcactcacagccatttaaaaacagaacttgcactaagttggttttattttttttcttagtaattaacagttttctatttgctcagggaacaggagttaccagttcatactgtaacagtgtatttctgccaattttgcttaatattaatttttaatttcacataaaagcttagcccatagcatttagcttttaaagtttaatctgacagtttcgattttacttttcctttttgtataataattatattgaaatttaaaaactaagctttatttccatggtttgcctttcaaaatcaacacacataagaacaaatttggccccaggcagagcttctacaaaaataagaagttaggcacgacctcgatcatagttgcttatactttctttaaaaactattgtgcttgtaggaaagagtgctgatgccaaagactgggaagtgctttactttgggttacgattagatttacaattttttgccaaattttggatatacaagtgaaagtccacggttctgctctaatcatctcagagccttcaagtaaagccttatctataattatcgttaagtaatacattttaatgaataaataaatgaagttaaaaatatacaacagaaagactgggcgaggtggctcacacctgcaatcccggcactttgggaggctgaggcaggcggatcacgaggtcaggagatagagaccatcctggctaatacagtgaaactctgtctctactaaaaatacaaaaaattagccaggcatggtggcgggtgcctgtagtaccagctactcgggaggctgaggcaggagaatggcgtgaatccagcaggtggagcttgcagtgagccgagattgtgccactgcactccagcatgggagacagagcaagactccatctcaaaaaaaaatatatatgtatgtatatatatatcagatatagattctgtttaatataagaactgattataaaaagtttttctgagaacaacagatggaacttggaattacattatctaattaaaaaacagttgaagtgttcacggtgtttcctcatcacataacaggctggaatcgaatagatacgaatcctgcaaagttatgttaggagtcgtctgcccgaagagcccagcatctgtgccatggagaggacaccagactcttatgtgatgccctgttactgcccttcagcttagagccaagctgcctataagagaccagcgtgcagacaggtggcttcgtttctattgatcaacagctggagaaggaacctgggatgggaattatcacgtttctctgtcattagggagtttttcaggaaaacactgccattgctttgggttctggaaagaagcgaggatgtggagcacaccttgcttcctgtccccaagaagggaattaaaagggaaacactggttagtgagcacatggcaggacagggcagctcctggaggtggagccgcggtcatagtgcgggtgctttgctgagacctactacggtgtgaggcatgccacgggaacagtgatccctcttagagctggcaaaactgctcaaataattcaccatcaaatctcaaaacacagtgttttcaggcttccttcatcaggcgatcagtacgttcacttaactgagaatggggacattactggataggaaggacctccatgatcctcaagaaagtttgaaagagaataaacaataggaccttatgtttatccatatttgcttttcgtttgtttgtttgttttttgagacagagtctcgctctgtcacccaggctgcagtgcagtggcatgatctcggctcactgcagcttccgcatcctgggttcaagcaattctcctgcctcagcctcctgagtagctggaattacaggcccctgccaccatgcctggctaatttttgtatttttaatagagatggggtttcgccgtgttggccaggctggtctcgaactcttgacctcaaatgatctgcccaccttggcctcccaaagtgctgggattacaggtgtgagccaccgcacctggcctgttacccatattcgtatgtcaacttgagcatctttaagaagacatctctgagtaaggagtgtatatagagtagagaaaatagcttaatgagtcacctctagaatcctatcgagggctaagatttccagctggtcctctccaggaaaaaggggtggggtgcaactgggattcctgtcaccaaggaatgctgatgccttttattattatgctataccagacatgtgttcaggagtcctgattcttatgtatttctagttcaattgtcattgtgactttggacctgttattgatcccggtattaatttcttcttttacctttccacatacccagctttcgccacagaacacagcctgtgtgttcatttgaacttctccctgctgggctgaatgtatataagacatcatgttctcattccttccagctgacaaaatccacgctgagctgtatgtatataagacatcagtgttctcattcctcccagctgacaaaatcaggttccatgtcaggttttcacacttggaaatcaagtcttagtgtattaggcattaagatgttaagatgaggtgcagccgtctagagtgagcctctttatttctttctgacgcattaccctatacttaacagcatgtcatgaaccaggtctggagtcgctgcaggtgggcctgacatatctccgcaccatgaacttcactggccatttctccttctagtttacaaaccaatagctcacctgtcactcacataagcctctttccatcagatccctggataggaattgttcacatagaaaatgacaaaacaaatacagatgggaaaggtgcttgtgtggattggttggtcactaacaaactcttctggcagataaattcttctctgtacagtaaaacacacccatttgcaacaatggtatggaagttctatcatggacaaataaatcaaattattcctgccctgtttttcctccagcacatagttgcagctgtatctcctattggagcctcagaattaaataggaaggaacataaagaaagacttctgactgcaactctatgtaggactgaaaaggtgcatgagaagatttagagtatttgtatccatgcttcttccattttaggatccactgagtttccccacatggggctcaaggaatatttattgctttcaaacattttttactgctcaaaatattttaagggtagtgaactaggtaaaggaaagggtaggaacttagggcttagcattttaatacacatcctccaagcaattctaatgcaatgtaaggttgcaaaatgatttacaagaatgaggggtttattgtctcctgcgcacctctttccacggcaagagtgacccttaaagagaattttagtccttagtttcagagcaaggttatgaacctcacatattgtaaattccccttcaccagccgtggtggaactcagagaacatttggttctctgcctgcaaggagaagggtgtgactggatcctgttgttactgcaccagtaaataaatgtctgccagtgaacctttaagagaggctgggccaaagagaagatgaaaatgataaggaggaggagaaagagaaggaggaggagaaagagaaggaagagagggatggaagaagaggaggaggaggaagaaaaggaggaggagaggacaaggaggtggaggaggagaagaaggaagaggaggaggaagaaaggacacagaggtggaggaggaaatggaggaggaggaggaggaggaggaggagaaatggtggcatcagctcaatctggcctttggcatcccggggccatttggtttctctcggtcatccttagtgggagatggtcaaagtcttccactcatttctcctaagtggctttctctgctttgattacaaacacagtttgaaattatttttggacagtctcctaagagcaacataagcacaaacataaacacaaaaatatctttagtgttccagcccgggactgtccgtctccttatgaaagtatggcatgggggagctgattccatctcttatgcttgatgtaagaatgggacgatgtgggtgtcttccaggttatacaaataatcacattttcaagttaattagaatttctcacattaggtaattcctgctatttcagagatttggttacaattgtattgcagatacatgccctgtaggggcatgtacatgccttaaaaattatttgcccgaacttcacacatggctttttgtttgttttggcttttttgattcaaaagaactcaagactttcttctgtaaactcaggggtgttttaggaagcatagaacattattctactgcactaaaagggaacactgtaagccttgattctgccctctgccttccttttttgaatagagaagaaataaaacgcacagtttgggtacagggtttgtcttcagcttctgggactcatgatgtgcagaggccgcccgagattcatttgcacagtgcttttctgagccagaaatatctggagagactgtggcctctggaacagctgcctcattcactggtggggtgggtcaaagcatgaggtaatcagagttctttcttttcctctgcacctgcaaaagcacatcgctaattccctcacagacgccaacaggcattcaggctaatgcctttcagaggaaccacagcatgtcccgcatgccgcagaagactgcctcaccacggacctgtttctaaaaggagaagaggcctaagtcagaggctggcttgatttgcatttctgttaggtgttgatggaataattgtcatttttagttgcgttctacatagagcaaaattattttaggcacacatattaaagcactaatgcaagtaggtgtgtatgtgtgttggggggtaattaactggtgtgccacagactgttctaaaacaccacacttgagtaaaaatatttaaacgaacctcagctagttctatttgaccattattagaacacaaaaacttaaccaaggaaactaacttcagaatttacgttgaataaacattactaggaaatagaggaaattagcctcacgtgaaaattgctatcgtggtcgaccagttcttgacacctcttgaaaaagagtggtccaaagcggagaattcatcgtgagagtggaatttcatgagcctcagccatcatgttgtcagtttttgaactttctaaaatgatgaggaattcgccttcatttctgatctattttgttgttatttctagctgtttctaaatggtgtgtgaaatgttttattttctagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttgggtaagtcagggttattcccaatttctgtgcagagacccctgcaaggtcaccatcagcagaaaattccgtaagtatatttaaaaggcactgaattttaattccttctgtcctcccatcaccaattgtaggagtttttatgatagctgtagatcgagtggccagaaatcaccaaatacaacttcagcaaatttgaagggtcgggggatgctggtatgctcaggagaaatgacccaggttattggatgccacttggacaatgatgcctttatctgtttttctcatggcttgccttcagcctcagcctaccaggtaggcctggtccacacagctcagacacggcagccaggacctccccgccaggcgtcttactctcgctcagcccaggtgggcgaagtgctctggtgtggagtttctgtctgttgacctggcatctacggccaaagaagggagtgctgtgagacctgattgggttttgtgagcattcctggtacagtccatggtgactacaataaaaacctcatatcctttgagtatatacccagtagtgggattgctgggtcaaatggtatttcttattctaggtctttgaggaatcgctacactgtcttccaaaatgattcaactaatttacattccaccaacagtgtaaaatcattcctatttctccacagcctcgccagcatctgttgtttcttgactttttaataattgccattctgacaggcatgagatggtatctcattgtagttttgatttgcatttcccttatgatcagtgatgttgagcttttttcatatgtttattggccacataaatgtcttcttttgagaagtgtctgttcatgtcctttgcccactttttaatggggttgtttttttcttgtaaatttgtttaagttccttgtagattctggatattagacctttgtcagatggatagattgcaacgattttcatccattctgttggttgtgtgttcactctgaggatagtttcttttgcagtgctaaagctcttttgtttagttagatcccatgatacatgcatgtgtatgttcactgcagcactattcacaataaccacacatggaatcaacccaagtgcccatcagtaaaacactgaataaagaaaacgtggtacatacacaccgtggaacgtgatgcagccataaaaaagaatgagattatgtcctttgcagagacatggatggagcttggaagccattatcctctgcaaactaatgcaggaacagaaaaccaaacaccacaaattctcacttataagtaggagctgaacacatagacacagggagaggaccaacactcactgaggcctgtcagtagggtagggggagggagagcatcaggataaatagctaatgcatatggggcttggtacctaggtgatggattgataggtgcagcaaaccaccatggcacacatttccctgcgtaacaaacctacacaccctgcacatgcatcccagaacttaaataaagataaaaaataaatgaataaagttgttattaaatctttttttctttctttctttttttttttaaaaaaacctcatatcctgatagtaattggcttgtgaattgaatctttaaatcaggggaagggatatggctctgaaaaatggatgtgttcttctgggcagagataattatagatgatccttatggcccctcttacagctttattgtcagtgtattttagaccatgaagattagcaagaatatatcattttacccaaatagccaaagtgttattttctttgacttgaaaaaaaaatcagattgactgttaactaaaagagaatcatgtcttaagatcatagtctgaagatttaggaaaaggtgttactctctttagtctttttgaaattaggcagaagcaaagcaatccttaaaatcaaaatctgatctttgtcctatgcattttacatccataaagaaagtggaggccaggtgccgtgactcacacctgtaatcccagcattttgggaggccagggaaggtggatctcttgaggccaggagttctagatcaacttggacaacctagccagactccatctctacaaaaaataaaataaaaactagtggggcatggtggcacatgcctatagtcccagcacattgggaggctgaggtggcaggatcacttgagtccaggagttacgattgcaccactgcactccaggctggccagcaaacaaatccccatctctaaaaaaataaaaatagaaatgaggagggaaatggcacttacattatgaatcggatctaccacatacacaataaaagggataatgcctcttgccttttcagttttagcactgtgaagtgtattttgagaatgggttagtgttgcagtttttttttttttctccaagtgagtttccctcacattcctctaatctacacagaaactcatctcaaattctaacttcaacaattcaattaattcctgtggagaacgacagtggtaactttcaaaaaaattctcagccttatttaacaaaaaatgcatctgtaaatgtgttacggtcttcaaattatgtctgcattctcatcttccttgctttcacacatgggaatttttcatagaaattggtttagttttgtttttgtctgtcccagaacatttcttttatgtctccactggcttgtgtgagacttccatttggttttgtactgatgctgatgttcctcaagtctccaggagctggggtttagctggctctccttttccggggtggccagttcactccgcttggtgtcattaacagttggaattgtcgtcactttgggaatccaaagatctcagggtgcctttgcttttccatgctctagagcagctgagctccatgtctgattttgctgtgatattgtttcactgaaggttaaaatttaaataagatataaattttatttcacctggaaatggtcatttatccagcatttcactgtttcaggtctcactggcttcttttaaggactctatgtggataaaatccggttctccaatgaatcaatgtccatgtaagacagaaagtgacggctgatatgactcaggggatggccatggcttccaggcgttcaaatctacctctctggttgataacccttctgggtgtctcgttaccaaatggaattactctaggatactaaagcagtcgcctttgagtaattccttggtagtctcaaatcggttatttttgcatatagataaaaatttgtccattgctagccctcatttgatactgtacagtaaaggaaaaataaatcttcactatcctattttaatctggattacagagtttgcctttttgaaggatatttataaatagagtttaggcctgatttggtataattttaaggaaatgaagggaaataatgagattattttatagaacaatttgaagaacaaatgaatcaataattgattattattattttacttatacatattagactgccccttattcaaagagtaactgttagaatggttttcttagacatgtgagcttgaagattaagcagatttgacagaatcatgtccgcaagcaaagaatatgattgtcatattaactgaaaacatcgtggaaatagttttaatgcatccatgttactttcgcaaatttcctataatactgttcatttggaatatagttaagggtcgatggaaaaatgtaggcagtatggctgtctccttgaaaatccacatgtaaatttctaccataaggaaagctaccttagcaaaacaaaaacttcataaacgggacctttccttttcagtaaagaaattaggggaggaagtgtcatctgaaaattggtatttctcacaaattacataagtaccagaatatttaggtgtttttctttaatacatgatgtcagtatgggtgtctgtatgggagattttccaatacaaagtggtttaactggaaggatgtactcaattgttttatcttttttctgaagctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggtgaggggcttacgagtgaactgacagaattacagatttcaaataacttttcaaatagtgatttcaaataatgatgatttacagttatttgaaaagccctataattatgcatttatttgaaattagtattgcatttctagccaaatacgccgctcttatagatattgtcttcatcttcgcaataatcgttagacaccattactttaaatgttctcctccggggttctcaggagagtctggatctcatttgagaggacgcttgccggccatggctccgtgtgtccctgttcgctctttattcttttttatgtggttaattttccctccctctaccatcatcctctaccatcatcctctaccatcatcctctaccatcatcctctaccaccatcctctaccaccatcctctaccaccatcctctaccatcatcctctaccatcatcctctaccatcatcctctaccaccatcctctaccaccatcctctaccatcatcctctaccatcatcctctaccaccatcctctaccaccatcctctaccaccatcctctaccatcatcctctaccatcatcctctaccaccatcctctaccatcatcctctaccatcatcctctaccatcatcctctaccaccattaaccgcatgggtcctctttggaagaaaaaaaacattatctttatttttttcacgaatgtttcttaaacaaccaaaattcagcgaaccagcaactctggacacaattctgaagagctaaacctctcctttgactttttttttttttttccccacattccctgtttacctaaagccccattttccttttgctctctacctaccttttcagtgaagacgtgatgcatttaccattcctggcattttcctccttccaaaggaaacgtcgtttattctcacaaccatatttgaataggctattgtgaagttagtaacatgggagccacatcctaaattcttttcattttggggctatcacaaagaaattctttcttacaagattgcagaatgttgtgtaaccataactcatgtgaaacacaaatttcaacaacttttcattatctttaagtgtgacaactctgcttaaaacaagtctaacacaattgtggattgccgtatgtgtttgttttcaataggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgagggtgagtagccagaagccttaaggtccaccttgaaagttaaaaccacacagctcgttctaaaatgcctggcaaaattctacaaaaattctagaggtttgtactatttatacaattaaatcttttccccgcaatatttgtggaagcatcatcagaaatcatgactgggtgcatggaggtattccaagtatccacaggtcccatcacacggatgcttattgtttgaaagttcgtaacacggaagcttctaatcttctcccagtgataatctatatgtggtgttgccagtgttttctagatcctggcagtgagtgagtggggttccagagcagtgagcaggaccaatgcagatcactgatgggaatttccgcaggctggaagcaggcttccttcacacgtcatttccaatctgttggtggcccctgtgtgtggagcactctatttcacaggaatctggggttatattctatgaactattttggagtgggtctacttgattctaatgtttgagaggcatcgtaggaagtggtggtatgctccagtaatgacagtaagaatagccacggacaccttatagacactgcactgtgtatcagaaatgtagcctcaagcaaaggtgaactgagaggtgatggtaaccatgtattcggagttcaaaacccgatttagaattcagacagataggaatgtaaatgttaggaattctttacaagcaaactcctcaattaaattttcagtctaaaaaggttatacaaattaattcaatatgtattgttgtatgtatgaaacactttccaaccaaataattttaccaacttgagtaagctcacatacacactatcaatgtgagaaatttaacttgagtttccttaatcttcatttattgtccttgactatactgtctccacttctgcctttattgtattatacattctatataggtaaatagaaataatgtatgtatatgatctatctatattatataatctatgtaacattaatttcacatataaaataacgctaaatattaatataggaatgtttgtgcatatatttgcatatttatatattatatttacccatgcatagtgtatatattttttctcaaagactatttttgactatatatgtatatatatgcatataatataggcatacacatatgtgcacacaaacatgataatccaagataattttttactctgaattgcctcttgacaatcaaagtagtataaatcttaagactaggccctaaaaaagttgtcttaggtcaaataccactgattagtagtgagaaatggttacccatagtcacgaattgcaggatcatacttttgtttttaactgaagtatgacactataaattgatataaatttgttaatcaaatgcaaatgttttcagttccctctcatcttgtagatatttcagtattaaaatttgcacatgagagcaatgttttctcaccaaaaccagagtgttttctactctttcatatagtacttcaggtaagcaatcctatgggataaaccattatcaccaatattttaacaaggtgatgttctatcttcccgatatgaggcactgaaaagagacattgtcatttctatggtattgccagtgaaatgcgtaacctgaatcgagtcctgaagcagcagcaataacatcccccaaaaccctaggggcatgcagcaaatcagcttgcccgtgttcacgaagaaacgtcaagttcagaaaagacaccgtctgagtgattctttcagatttaagagacccgataagtgcaatgtgtggtctcggattgggtcctacactgagcaaaagagagttatgagaggcgttaccgagatggtagagtctgaccctgagatgatctaggtggcgaactgacacaggatcttaagacaactattaaaaatatgtccaagagcttgaagtgaattagattatgggtgtgtatgagacaacattgcatcaaagttacatttcattcttttaataattgtattatggttatgtaagagaatgcctttgttcttaggaaatacatactgatatatttaactctaaagagttgtcatgtctgtaacttacactcacataccttagaaaatacatatttagagagacagagggagaaaaagtgagcaaaatgtaaacagtggatgaatctgactaaagggtgtgtaagaatggcttataatctttttgtgaagtttgtttaatcctgtagttataacaaagtgtggagttacaaaaaatgttgccaataaattaaaacaatttccatagtaaaatttcaacgtttctgtcaaatcccatttaacagtagcttaatgtatctgtagcatttatcattcgggacttttggaaagcaccatggtgggtttgtgaattgtgacattttggctctagacctgattctatgtagtgatcacaaagtcttggttctggatcttaattctccattgtttaaaaacagagaggctgaaagatcactcatcggcagtattttaattgaaatttaaaatatttcctcaatagttacaaagagggctggatgtcaataagtgaatgctggaataattattcagactttatagatataatctgatgctgattaaaagcagaactatccttctgttttcaagaatattaaatgcaataattgagcctaaaccctggtttgcagcctgaacttggtgtatgaagagcagagactctgacactcccagaaagtggaatatgaaatattctatcaaagatggccattcacttgagactgtacattcagtatcatgtttacctcaagtatttcagttttgaaaacttaaaagatgaacaaaattataacagttgagggtgggcaatgtttttccttagcaatctcacctctgtggggctatgaaggcacactatgagttctagtccagcaaagtacacattaaacaatttatttgaatgagagcttaattgcgtttcacttcccaatctatctaactcaggcaatgcaaagtatttttaaaaattttattttgctttctaaagttagacatttaaaagttttctatgaaaaaaaattagaaacttagcccttaaaagctgcatacacaaaataagttacaaaaatgttgcaatgctgaaaatatttctcaaatatatcatgcctcacaaaattgattacttctaaaactgcattatatgatacggacatcatgggaagctgaataagcccactgcaatatatgttacacccaataaggcaacaaattatgtataaaagtcataaaatcagtgactgaacacacacacaccagcaaaaatttgaaatacattttggagaatctgtaggttttcattttgttccttgtttgttatcataggtccaaatcactgaagtgtgagttcctctcgatgaaaaaggatgtaaccagtggttgcatttccaggaagcgtagcttctatgactagctatgacttgactaatcccctagttaagattattgcaaacctgatgaaattatttcctctaaatctgtcaaaaagttagatactgatggtaaattgaataaattataaaaaggaggaggaaattataattctaaacgaaaaatctttttaaattcttcaactcaaagaatttatattgcagatatatttccttcacattaaatcaaatttgcttttgttagccatctagtcttttaatcataggctcaagcttaagatttcaaatggatctatctcatgaagttgcattacataactaaaatatttagtttcagctgtattagggaactcttaattctctttcagatgaaattatgataaagctacactttactcaataagtaagagtgatgatgatgaaaataacaatagcataagctacaagctaactcattgctaccactaatacatcagatctcacactaggcattttacatatagcgtgggtaatttggtaacagccgggaataagtatttttataatactcattttatggttaaaggcactatatctaaggaatttaaattgattgctcaggtttatttaacttgcatgagcagatattcacatctatttaactcaatttaacagcaatttttgtcatgtagcatgcaaaatgaacagtactaatatttgtaaataataaagtatatttaaaataagcataatattttattatatgctgagttaaagaaattatgttttagctgaagaagtcacgttaacaaaatgtactttttataaaagcatatttcaaaagaaaataaactcaggaaagagaaaatatggcaaagtttaaacttacaggttaatttatttttcttcttccagtttacttttcctcttctaatttattgttcttttttctcctctaaatttaatctattgttttgttttagtcttagtcctgtcttataattttacataattgcattgatagaaaagcggatatgttgacattgccttctagtcattttcatagttataaccgtgagtgaaagtggtttttgtcagccaaaaaaagagaaaaaaactaatcatgaattttactttccacagtacaatatttgaggggacattcccaatattaggatagcattatgctggtactcattcattaacaatattagcaaactaacattttagtttccttacaaactgaattgaaatttttcatcggttatttgacttgtttaagtattggttctacctaggtggcttttgaagatttagacatacaattgaatagcaaatgtaattagaatacaatgtaacaataacatcagtgtcctctttcggtttgttaaactatgaattggaccaaactcactccctttctgtgacaggctttccattagcccatccacacagtacctgttgcacagtaagtgaggaatatgtgtttgttgaatgaatagttgtcttggatagtccaacccttaattattgcaaaatgaaattttgatatatagtatagttatcataaaactttcaagttttagagagccttaaatagtatgtgcttctggattggtaaatacatcccaactcatatgccaaccaggaaactactaataggtctgtgttagaaggggttggaagtcacaccgtgaaccatcagagaagagggctgtgattgagtacttctgtctgccattggcacgggaccaggaagcaccagcgtgtgcactttgtattatttttttcaaacaagatccagttcaacctgagcacaagtgctttatttctatgtaatcagaagggtagtccctcgactcccagtacagtgacttctctgtgctgagcaaattttgcaggatgttttcttccatgttcttttaagaaaaatatatctttgttctccaggccagatttgaaattgtttcaattaaatgtgcaaaagtatttttaaatattttgatcagctcagaggcagtctcatgatatatattcttgttaaccagccaagggtcacttcctttatttacctgcctattgtatattattgcaacagtactaaggagaaaatgtagcaatctttctggtaaataggctcgactaaaaaagggaaaaaaaaaagtgtagattgaaatgttcaccctgaaacgtacccagcggcagccgagcttgcttttgtttactgactaaagagcgtaaaaaataggcacagagtgtagacctgttgcactgaccatcgttaattgaggccttattgcctgtacatggcattaggagccttttgagagaaatgtaaagttcaatcatgtcaaagccaattaacacagctgctattagagctggtaattattgaggacaccattttacaaagcagttcaagtacagtcattcatacttctgaggcattctttattttccaaagtgaattctcctggagatgtaaaataggacctgaattgcctagattttaaaaaaatacagtgattacataaaggaagatgcttcagtgttgctaatatcatagatattcttttttaaaaatcacaacaattctgtcacggcattaaaaacattcaatccccaaatagcaaggctattaaaaacattcagtccctgaataacagggccttgaacttttagtgctttaactcatgttttaatttgtttagaaatagttcactttagaaaagacgaattgaaaggttatttttatatttgtagctaatcagtaaaataaacatatgagccatagtaagccatatgttaaggaacttccataggattgtgtgctttgggtttgtaataaatgtgtagtctattgcactgatacccattggtctcttgtgtttgccattttcatgctgggtcactcactgtgtgtggtggtgttcttgtttgcctaacagccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaagttagtaagcagacatcatggtagactcagacgttactatgaaattcactccattgggaaaaaaaatgactttaaggtgttatactgtttttttatttttaattcatagaggaaaaaagggaaaactatgtgtgacattgtggctgtatttcttaagtactttaagattttttttccagttgcttattcgtatggctgaagctactttaaaaggccagttcagtcaaacattgtaaaattgagaccaaaaaagtccagactttgtctgtagaccactgggtctgcagagaaagaagaaatgtctttggttctctggctgcaggcttcatctttctgattataccccatgcctaattaggggctagtcaaggggtggaagtcagcatctgacagccagctgccaacggaacagaaatcagtgattctcaaaatacaagtgttccttctgacagcgggtcagtgaaatcatcacacagagggtagtattgctgtattaattcactgcttaaccactgtgaatagcaactcagagagagtatcttgaatagaaatggtgactaattcatttcatggtaaatgaatttctctgattctttcctgttccctgtttattagttataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaaggtttgtttggtgactctttggattttacagatgtgtatagaagtctttattgaattatgctttgtttaattttgcaagcatttatgtagcccttctaggggctaggaattcttgaacagcaatttgcaactattaagtcactttatttttataatactttaatctcagttttacagatggaaaaactaactcatagcgaggtagaggaaaaggcttaggatcacaaaccaggaactggagatgtcggggttcagtgacggtcacgccaccctagagtctgtgtctgaaccccagtgctttgctgtcctgggtaaacctgtgaccctagctgtgtgaggtgttcgtggcatggtgaatctaattgtaggaatttagaggcaggttggagagacgagccaatcacctagtaatggcagagcactggtagagagtgttagcaccgtgatgtttcatggggtttggttgccgagactgaagatgacactggccgagaaggcaggaagaggtttatgacttatgtgactggaccctctgggcaaatcaagacaggctcaactcatcaaggtggcttcagtaaagcagagtgagtgggcttggctcttacagtgacagggagcagggctgagtggcggctgtgcaagggccagggatttgcgtggtgacagtttatttaccagaagcaaagaagaactatccagactttcttatcagctggtgcagaggaaggacaagaagagggggagagaggggcttgaaagctgtcagtgaccaaacataagaagatggcattctcctccttattagactaggaacaaataaaatactgagggagggagagttaggacactcagtagcttatggagaaggtttcatcttcggtgagttctgcaagacacatggttaaatgtggcagaggcttaaatgtgacctgaatgctcaaaaatatggctttctctctcttctgacatgggcgtgttcttggaccatcctgctttcgtctcccagtagagtcaaaggatctcattgccttcccttctttgtattgtaactcttaatactgcacctgtgatatagctgacgctaaataaatgttgaatttgaatgaaaatgcactacgttgtgtcggcagtattcaggtcaaatggtcatgatggaaattgccaataaaatatgcttcatgcataattctgtggatttttatcctctttctagtacccattgtgtttgtaacaacaccacggccagcaagtccctaccagatgggacctctttctctctctgtccctccttgaacttgtctcctcccattccccctgcccccaggggacccatgtagctcaggtctcttccaactggggcctccccctggacattcccttgggccagaacacgcatttccccagccctcgctgtggggtctcaggaaggatttgttgaacgagtgaacagatcagtagaaggtggagtggtgagggaaggacccatttccaacttttgggtgtgcacatgtgatttgtgtgtgttggcatgtctttctcacgtgagaaggcatgagcctgaacacacaaaatgcaagcggttgttcttttgtagtgccttctgctacctacagggtcacttggaaacttccattcatttcaaaaactagggaagttgtgtatcttcagagaagaaggattttagacagtggtttttggatttttgcctccctttgtgcattttagtataatttctagagtggggaaggtgatctctcgtgacatcaccctcggggaaatcctccctagcaaccacgtgcttgcttctcagccccataaagtggacatcaggctccaaggctgtgatgaaacacttgcaaatggtattccacagcatcttctttaaccattcaggcatttctaaaaaaatatattcagtaaatagatggaccgactgtgtcttttggaaactatatgccatctttaaataaaaaatacagatggccagaaaaattcttaccatctgtgcctataaatttgtgtcatctgaccaaatcctcattcgaattgtctttggtaaccatcataaaaagacacaaattaagcaagaacgtttcttcctttcttggccttgtatatattgggaatgtcatgttcaatcctatatgttttgacttgactttgcttttatagacttcatcgatattaatgaagaaatattctaaaaaatattttgttattttgatgtactgtcttccttggcaattcttttattatttttttttaaaaacctatgtagatgtcatttgtaattcaggtaaaattaaaatgggaatcgtttgaacatcaccgctgcagcgggagctccggaatgttgatcttgtttgttctttggaaatagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccgtaagttctacagcagaatttgttccgcccactgcaggtctgcaacagggacggataaccagggcacatcctaaggttacaatctgaggaccttcctggtgggtaataatagccctaaaatacacaaaaactcaaacttgagactgtgttgcctaagggcagagtctcctttttgagacaggtcctcactctgttgcccaggatggagtgcagtggttcaatcatagctccctgcagcctcaatctctcgggctcaaaccatcctcccacctcagcctcccgagtagctgggactacaggtgtgtgccaccaaacccagctaatttttgtatttgttgtagacataggtttcgccatgttgcccaggctagtctcgaactcctgagctcaagcgatccgcctgcctctgcctcccaaagtgttgggattacaggcgtgagccaccgtgcctggcctccttttagcgtttttcttgtttaatagttaaagctaaagatttaacagaaactagttaccaagctcaattggtgaagctgatccagggacgttgaaggctgacttcttcctggttatcttccatagctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattggtaataattatcatacagctctggggatacctgggagtatttggagatgaggacgcttcattccgaaattgggtcatttgtgattacatagaaagtgtttccatagacagttttctgtacaaggtaataatttttgcactgagtaggattgcgcactcatcagctaaactgatgtgccacctcttttaaatcatgcaaaataagtcagaagtctgctaaagtagctactagactttgttctctgacctcagtggctctctccgctgtctaccttaactgccaattgcattgtttaggggaaaggtgcaggtaggaacattctctaaagcagccctccccagagagacagtcttgctgttgttttattgctgcagagtcaagttttatcgctgggttaattttgttcattgagatttactaagcagaataatgggtgttctactaatttttagtaaaaaagtaatacttagtcttgattattttctaagaaattgaatagtatccacctagaaaatatagtattaaagaaatattgtcattgaagcattttttctaattagaagaatatttgctgtcatttgatttaaactattgctatacagtagctatctctacactaaaaatatttttcttccccctagaaggttagtcactctagataacaggttttaagaagttatctgttttgtttttctactggtaactgtagagcagcaagtaagagagctgaagtgccactgggttacccaagtcctgtgttttttgaaaaatgtcactcttggttttccatgtggttccattatgaagcattaaatatatttttcattttgaaatgttgaggaaaattaattaaagaaactcagaataatgtaatgggtaaccaaatgagatggccaattattgaatcctaataagcaaaaagatagtgataggtcattattgaagatagtatatcattgaccaaatatatttctatagaaaaaaaagccagagaatggaaaaaaaatgcacttattcttatataagaagaacatactgaactacttaaagtctaaaagttaacatctaaaaaacatgtcttgaagagaagataaaagtagcaatttaatttttaactttcctgaaaaacatcttgcacatttctcaaaacaatattttctctatttcatgagaccttttagtgaaagctgttaaaattctcacaataactatatctggtgccctcttttctttttaaatcacaaatttcagatcctgctcataacacctgcccagaccctggtacgccacactttggaatacagaatagctccagaggctatgaggtagttcattatgaatttactatgttttctttctggaaatataaaatatatttgttacttaaacatatgtgagtgcttttttatatcataccttattcatgttatatttacctgaataaaattcgttcaaaggggatttctacatgtgtttttaactgtcaaaatcaatatatgtatatatatatatatatatatatatatcttgcttactagataataatggaataatgcataatttcatatagaaattaacatagcaactattacattattttctatttgaaatcatgcatgattctattatttgtctgttaaattctcacggcagttctcagattggggtaacttgtcactgattagctacccataaaaggttccacttagggactggatatagtggggaaataatattaaattctagagataaaaataggagaaaatgtatgtaagccccttagtctaaacttacttgtgaaattagttctccgtatgatctttaaatttctatgaattattagcgtactaaatatcattttggaacgttcatttgacttttaataaaatgaacactaacacttcagtgaacgttggagaaatacctaaaagtggaaggtaatgaagcttgaaataaaatgttttaaccatcttaagtactcccataacttcactgttatctggttggatgactttgaaaacaaaagttaattatatagggatctcatcaattaagaataaaaaaccttcttcctcagccactttccccatctctcgtgagcacgaaaatattcccattgttctcgctcggacacagagtggccatttccttgtagctctcttgcatcccacaggggaagtccttacagggagctaataatatactgactctagcacattttctattatgtctcaaatattgccttaaacttcaagtaaatactttcaggtatataaatatttaatgccaaattgtcaaggaatattggaaaatactatatatggatgtcgctctcactgattcactaagaaaaataaaattttgatcaccattgctttgagcaattcttaacttgcctatgtacaacttacagtaattaaaagtcaatgatgactgtatttagcaacatagttctataacctatcatatgacactaatagggttggataaatccttcaccctccttataacaaattagttacactaacacgaataattgattttatccaacagcaagatttactaataatttaaagagcccagacaccatgttttaaggagaaggttgagaccatgaaatgcagctctccccaaatgtttttatttcttcctttattaggaacattttagtttttaaagtaaccaatgagatttttgtctgttttctttagcaccatatgctgaaaccttacttacacaaagtgagccatttcagtgtgaaatgtccctgtgttaggctatgttaatcttgcagcttaaatgactacctcccgttctccagccagcgtgtccccgaaacccgtagctccagggttagtgtatgataatcagtttgcagtggctcggtatattctgctaaaaaaaaaattattgagaaggagactgtattttctttctgccagtaaatgatacaggttatccatgaccttcctgagaatgtcagcatgtttaccaggaggtctggttggaattgcaaacatgcttgcatggagagttgatggacaccgttcctgatagagaggaagtgggctgggagcagcagctcacgcctgtaatcccagcactttgggaggcccaggcagaagaatcgcttgaggccaggagaacagcctgggcaacatagcaagaccctatttctacaaagaatacaaaaaatcatctgggcatggtaaggtgcacctgttgtcacagctgtgcagaaggctgagatgggagctacttgagccctggaggtcaaggatgcaatgagctatgattgcaccactgtgctgtatactctgggcaatagagagaggccctgactctaaagtttaaatcgatcagtcaatcaatcaatcaatcaagagtaaatgagtcaacgctttcccatcattgaatcttaaattagctattgatttgacatttagataaatttgtacttttctttataaattcatacttccactttatcaagtgctagaagcagcattttttttctcctgatatcctttcacactattcagtgtaccaactatttccttgcattttacttgtagttattcttcccggaatcccaacatgggaggtatgggcttatgcctgtgagaaggcagacacagggaattaaataactggttaaaattctcagagcaagaaacaagaggggaattcaaatctttggatgctaacttggtgcacttatgtgccttcataagtcaagctttaaggaaataatctggtcccaagccaagctgggatgagtgcaaacccgccttccctgggggctgctttcctctccctgtatacatgagtcatgctggcctcatgctgcagatacacagaaccatggatgatctttggtgcccctcaacacacgaccatagctcattctctaaaaaagacatttacagatcacaggaatctgcccctcaaggcacctctggttaaattaggaacacacatgggtgaataaatatacaggtaattccaggacactgtggtgagtggagcagatacgttggggaaatgcattcaagctgaatgtgattcattcttggaggatcagagaagaatctgcagcggatgtgcagtttaagcaaagtacagagaattaagtgggggttagctttgtgaagacctggtgaggaagacgcctcagacattcagacaacagtaaatagtttgtacagtttgaagcatcagaaagacaggtagagttttggtggactctgtatgagtaggagttgaccaatccccttggaatgctaacaaaagtaattttctaataaataccagttgtttcaaatgtgagtggcaggaaaaaaatgaaaaaggaaataataattattacaaacaaaaaagaaagaactctaaaacagaaaaggcataatttctttacccaaacagccgtctaaattttcaaaattcgagaagatcttacattattcattgagcaatctacattgtgtgtaacactgtagcaggcagttaaaatgtacatgttgacttagacagtggcttgacattaacctgaaaagttgctgctgtacttttactcgggcgtgtactttcaggtatcactagttgacacttcgtatattcccttggcctctgaagctagtattggatttcctctctaggttggaagcacggtttttttcaggtgcagaaaaggctaccatattcaaggttccacgactcgcacctgccttgccaatttaacatggagtgggatacagaccgaatgtatacgtaagtgtgatttcttccacccccatcacaagtcacctatttattgtgaatgtctgagacgtgtttaccactaagggaaataatgagaaattgtttttaattccctaatcctaaattttcggatgtcctcaaagtttggttccctagaactggcagcataaccattggctggacattgggctgtgaaggctgctctcaagccccatccttgaccttgaaccagagcctctggagggagccagggaggagagaagggggacagtttagtttaacaagcgctccaggagattctcaggcactgtaaagtctgagaaactgcatgaaaccgaagataagtgcataatgttatattgaacattcttagagggaaaacttatttgtacgtgctattattctcctaggatatttacatcaaattaccaaagagaggatgaactgaataacgtcatatgtcagagtctaagtagaagtgtttaaaaaattattcttgctataacaggaagtatatatgaattgatcattcaaatacatacttaaggatcacattttattttgtgacttaatcatgagaattagaaaaaatatatggatgagtagtatgtgaattattcatttcactcactctgaatttagtgaaatgcggtgtcttattcttactgtattaaaaataaaaacattaatagaatgttataaaaatctcagtatataaggtgtgatttttgggtgtatttattttaaaattatctctgctctaaatcattactcaaattatatgttgatagtacatgtacatatatatgtatatacatacacatatatatatgcatgtttatatataatatggagcttgataatatcaggtatttgttgtggttactaattagtgaaatagtgacaacattcaaaacaactgcatgcacaattttagaattgtaaacttggctgggcatgctggctcatgcctataatcccagcattttgggaggccgaggcaggtggatcacgaggtcaggagatcgagaccatcctggctaacatggtgaaatcccatctctactaaaaaaactacaaaaaattagccgggcatggtggcgggtgcctgtagtcccagctactggggaggctgagtcaggagaatggcgtgaacccaggaggaggagcttgcagcgagcggagatcgtgccactgcattccagcctgggcaacacagcgagactcaaaaaataaataaaaaataaataaataaaaataaataaataaaattgtaaacttgttttataataatatgtcaatcctttatttgcagcatgtatgcaaactttataaggaatggagtgatttgagatatagagtatacatcacagtctcatttattcctaaattatatttcaaagaaaataagaatctatattaagtttctaaatacacattaaagttttatcaaaataattaattaaattgagtaataaatttggtagtttccacaagaacaaaatcaaggcatatctaaatattcaccagtctctataatttataagactgggcttttaaggatctttaacatatttatttcggtagtatagcagaagtgtttttatttcaaagctgtgatctctaaatctttgcacataattacctatgtataaatatatataggatgggtgtagtggctcatgcctgtaatcccagtactttgggaggtcaaaacaggagaatagcttgaggtcaggagttctagcacagactggacaacatagcaagacttcatctctaccaaaaaaaatatacatatatatgtgtatatatatgtatatatacatattgactgcataaccatttccaaactattttaatctattaatttctctagacacatgtgctaactttacaataaacaaagtctcaatgtttcctaatgttgtttcagctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaagtcattgatcaaggagtggcatacttttccaaagagcaagggaaaggatcagctgcccatcaggctagtgtccacgtgtgagacccataagtaagagcatgaggctgcagcatcgccacctgcctcagtcgtgcttcatgtgcgtgagctgtgtgtgtgaacgtgtgtatcctcagtgtttgatgcaatggtggcatagctaaatatatagtacaattagtatgcaattagtacataataaaatgattgcattatttcaagccaaaagagaaaagctatttggttaaagaaaagcattctgagttaaaaggaaaataatacttggtatagtttcaggaaaagtagttcttagagatgaaaatgaataaaggtcaccaagtatccgagaataggtaaatgaaactctgtcttatttttaagaccacatgctgtttgtggtaaaacctcagtttatgtgtccctgacattgattctgctttttaaaattacaaaagcaattcacatggaaacgatccattaattacaaatttgtgtgtttacaagtgagagtcatcagcctgggtcagatttgacgatagctacacttacaggttctcccctgtttgtaatttataaatccatggagtctaaacagcataaaccaaaaatgatggcgtgtgagacagtcagtgactttaggttttgtttcctggagcctatttatagttctcatattagggattttaaagagacttttgtttcccttgcccttccctgttagaaatagaagaatgaaaacttttaaaatggtaattcgtagtttgatctaaaactgtgaaagctaagaaattatgacgtaaatctaacttgatagaccaaaatgaacattctgcaatggaaataattttgaatttttcagtagtaacgtataaattgattgatttgggtggggtattggtcaatgaagagggactgtaacatcatggttatttgggtggggtgttaccttttagtatgtggcagggtattccaaacaggatacaagaaatgtcatagaaggcaccctcctttgcaaggctctctgttgtagcactttaaatggaaatatacgtagatagatgtacattgatttttcatccttaaactccgctttcccacaaacaccaagaatattctgctgtaaagacatgagtttaaaatgtatatgtataaggtattcatattttgtacattaaaaaaatctggagaaaggaaaattgcttcaatttgacattttttcaaacttactcaaaaataaatgttttttttaaaatgataatttgtctttttacttgtaggtaaaggagtgagagaagttaatgaaacagttactaaaactccaggtttgtataccagaacagttctagatttcaatccaataaagtgatttgttctctactctgcacagtgaaactattttcaacatttaaatttctgaatccgttagtccacgaccaagttaatgtttcaattatttaaaacaccaagcttacatggaattctgtttatttcacaacaatggtttgttaatgaaataacattacttcccttaaaaagaaaacctttggtgttatcacaccctgtttcattcaaacttgccttcggcatttggtaggcagaaatgaaaacattggtcgttccatgtggtataatggagagccttataaagagggttgcgacttttttcctccaaatgaggaagctcatatcaatgaggcattttcacagcataagttgttaatgtaaacagttcagacatggagcccaatttttttccaagtgtctccattcatctaggcatgctttgccttctaaaatgttaattatagttttttgttgtatgtggcaccttttgctaaaagcattatatagcaaatcgcaaagatgcagtcctatttcccaaggaaagtttttactatacaaaatcatctggcatgttctgtgttttaaatttaaattatttttaaataacaaaatgtatcccaaattatattaatttaagttgggtattttgttgttgttttatcagaaacagaaatcctttgtaaatatataagatcacttgactagtactttctttattcaggttttaacactgtttttttttttttttggacataagctctattttagaatcaaacatggaaagagtatttgtattgctattgtcaggatactgtgtgacacatttaattcttagacaaggaaaaatattgtcaggatgctgtgtgacacatttaattcttagacaaggaaaaatgtgccaatatgatgaaaggaatttctccaatctgaataataaagaatataaaatgctttttaaagctttctagactattttatttaaatattacctaaaaatcacatacagaagtcagtgctctttatccaggcaacatgttcttcaatggaacaaaacacagcctctttttgttattattgttgtgtgtgtgttttgttttttatttgcttattttgtgtttaagatattgaaatatctatacactccttttgtaggtgcaaacattattatcaatattccttttcttgtactcttggaaagcaagtgctaattgaatgtgattcctcatcatggtggtacattctagtacagctcagctatgtggctgctgcattgtactgcgggctgccagcaacaagtgaaattataaagacccagaaagatgacctctgccacatgactcgtggtcctattttaatacacagaagccacttctaagacattggttgtatcttaccctacccagccaggcctggcccattcctgtgaaacttcaacaagattaacttaagtgaatgcttgaacaagtggattagtaacttcagaagagcatataaattctaattagggaagatattttttatgtactttaaaggctattaattttagtaatggaaaataaagttattttgaggttgctgattaaaatgggggcctctgttgtgctgacagtggctaagcagatgtgtctaaaatcagtgatttataagcaaatgtgttagatacttgtgtggatatatgagttttttacttattttattatcactattattatgagaaagtggggtctacaaaaggccaaaggaagctattatcttctgttcctctttaacccttctcttgctaggccaagttttataggttcagcctgcctaggaaaacaagaaaatggccagttgggctggaaagaaaagcatgggtataggaacaatatacttttgtcctcattatttgcgactataaatggactttttaaaaaatgggttagggagacatgaatcttcatttccacctagcaactcaagcaatgtgttttgaccaattatgcttatcatgaatcttatctaattaaataattcatgcacatcagaaggcagaaaacaaagagtaatgctgaaatcatcatgtgaatttatacactacaattcacgtttatgtgtgaaaatggcaggattttatacacatttttaaacagacacatgaaaaataagtttatttttttcttaagccgtgaaaacaagaagaaatatctcaataatctttgttaagttttcctgtcgatggattctgtgctttaaaaagactgcctttcattactgaatttaaaagacatgtataaaagaaacatttgaaattattgagcccatctcttcttactcatggaatatattacataaagagattaaagaagaacagaagagtatgaatgacagagagggactctacttacaaaataaagactctgaagtgaaagggctttgtcttcataagtccacttggtgctgggatatgtaagctttttcgagacagggcattgctctcgtattatatatatcagttctttggagccttccaagtctttcaaagagtagacttggatatcattgaaatatcagtagtgatttcatgggtcaggtaaacatatttcttgctaagcacaataaaaactaaactagcattagaagtaccagttcaccatagcccatgagcttggaagggctgttaaagtaggtatgctttggcttctaataataataaaagaaacccataagcacaagtgtctacttgcataccataataatcttcgcacctgcttcttttgagttttgcacgtgctgtgaacagcgatgcactaggctcctcttgtcttcatcactgccctcatctgtgatcgctcgctaagcagtatgatgccttctgtgtttaataatgtctgaatttattgtttgtgtgtgtgctgacattggtctgtttccccccttcccacagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggtaggtcccgaagaattcactaaacgcatggtgtgagcagaaatagacctgttatcttttcacagagaggtgatctagtaagtattaagtacttattactgttctgttggctttgtatatactgtaactcattggagcctctccctagccgtgagaggttggtattattttcttattttagagattacaaaacgagtacagaaaagtgaactgatttgctcaaaattatgcacatattaagtcaagaatctgagattcgtatacagatactgcatgtctccaaactttatttcttaatactttttcttaactcatgtgctcttcatgagatttttaaaatcatcacacaattaataaaataaaacagcctcgatttatatggcaaacactattttaagcactgtatgtgtattatcattttcattcttacattaattctgtgatgtatttttactgtatacttttttagagagagattttttaattagcaaaatcaaatatgttattttttattctttctgtggaataaggatattgaacttagtggagtggattatacctattcaagatagacaaggatttaagaagtgattttcaggggaaaatggaagctcctaagctaaaattcacaaataaaaatacaatttctgtttgagttttctattatcgatgatattatcatctccgtaccacattccacatcaaatggattaaagggctgaattactaactttctccaaggtaagcctaaactgctgatcttttcacaggcatttacaagaaggaggaggcccacttactcctgaaagcttttcaaattaaaggccaggcagatatttttgtaagcaagttcgaaaatgacaactggggactagatggttatgtaagtacatgtgtaaggtctgtgacaaagcacaggctttctaatcatctctctgtgcagatgcaagggctacggattggaggcttctgagtagagctgtcttgtgtctgccccttgaaaactcagctgcccctcttcttgacagagtggccattttattccttcattttataagggaagaaaccaggtctaagaagtaagcaatgaactggccatccttaaaggggtggttactgttgaggacagaacaagacctgaaatccagggtctatgatgttactgctacgttatatcgtgagtggtgccatcagaaattttccaagaccgcttgataaccacgctgctcgttctaaaagaaatcattcccagataaatagaaagatttaagacatcccccttaacaccgttctttgcaagttaaccatttgttcgtgttctaatttactatctgacttaagggtagacagccatacatgatgtaccctgcccaatagctgggacacaaagtgagttttacataatgtagattatttcttaattcatacgtttgtgttcccttagaaagtgcagttaacatatggatatattgtaaaatttgctatcattttcgagatcaaaatgagattgtgagcatttgcatatgttagttaaagttcacttctgtgttggtttctgatctttaactataaatgtgtcaccaaaagccatggcaaaaataaaacatttaaccagtagtatctaaatatgagatataacagttgtattaaaagatatattaaaagaggatattattcatcccttcgtatacctttttatttcttttcttttctttcctatgtgtcaggtgtcatctggacttgaaagaggaggatttacttttcaaggtgacattcatggaaaagactttggaaaatttaagctagaaaggcaaggtaagttgcacttaggatatattttaaagcaaatatcagtttggctttccaatgatgtttctaagaagaaatggaaaagacgactctaaaagaaacctaaacaaaaataatgagagagactaacatattttacagctgaatgaaaaaaaattattttgaatagcaaaatacacaaacacaaagccggaaataatgcaataaatgtgccagacatcatatcttcactatatcaagagctattaaaaataagagagaaaaagatgaaaatcaaagtataagcaaagtatattacccaaagaaaactaagagttcttaaaagtaaaaaaaaaaagtaagagtaattaaaagtggccaacaaacatataaaaagatcttcagaaatatacatatatatatttatatagtaacaaagatgattatttttagttatcagaatgacaaagttttaataattggtttggggttgatagcaggaaaagatgctcatgtttaattttgatggatgtatgggtagatacaattggtcagtactttgttcatccaacaattttctgtctagaatttttaatcaggcaaatgtgtaaattgttttctgcatattcaggcgtgtccaaagcaggattgttttagtagtggaacttagaaataacctccgcatgttgcccatctatgctgaaagaattgcttcaatgagtatttttatgtaacaaattatactacctatgaaacaattattattcagtatatttatttaaagaaatgaggactatatattgatgtggaaagaggtttgacttataaatgagaaaaagcttattctacatagacaggtaagtcctccttccttctttatagctttctgtactatttgatttttgccttagtgattaaaggaggaacatatgtggaaacaatcatcagatctgaatgctacctcgtctgcttcctatttttgtcatctaggatgggtcacaatattcttgagcctatttcttcatcttaaatctcagtatagaagttcccaaggttgttacgagattgagaggccacgtaagcattgctttgtgcatgctacagctctttttgcacaaaagtcgttataattgttgcaacccacaaataaaaggaaacgcatttttgtaacaaccttggcaccatatttctcctacttgtagaatactattcacacagtattactataaagaagaatattaccatataggctttgataccagagccaccttttggaggaatgtgagtgtacaattttgtaatgattaccactgatgaacttattttgtaagacttttatcaaagtgctgaatataaaaaaagtctactggcctgtagaaaagccaaaaaaaaaaaaaggataattaatcataaaatactttacttccactattcaacccacagtattattaaatagaagaacattataatgttggcagtggctgagattatatgttaaattgggttatattattttgaggtaatgaaatggaataaatgcattagaccaacactaatgatgggtgatgttttttctcttgctctaagccgaatcctggagttatttgtcctcctttctctctgtagcacacgctctagtaattttgttgaaggacaccccagtgagctgtacaggatgctgtgtagatgtctaagttgactgatccaatgaatttgacctgaactatcagtttgctattacacgttttctttgcattaccccttttctttttaatctaacaaaataacagcttggtttaacaagggatttttattctcatgtgatgatgagcttgttgtcaggaaaaacagtttactttacaaaataatttgagtcataagtaagtccccccttcaactaattagaaaagtttgtgtttacgtaattctgcaacagcaaccattcatttaagaatgatggcaagcatctatttttatggataaaaataacctcctaattttctctagtcagtagataaaccaaaaaacgtgattgtcattaagtggatactaaaataaaattaatttgaaagacaaatttaatgcaaaaacttgcgtaagaaactcaacaataaactggtttcctcattaggattgaatgactcaaccctaacatacacacaaagaatgagagaaaatacataaaattatgtacctgataagtgacttgtatccagaatgtacgaagaactcttatggctcaataatacagaggcaaataacctaaataagaaattgaccaaagatttgaatagatatgtctctaaagacatgcaaatggcgataagcccatgaaaagatgttgattataatcattatcagggaaatgcaaatcaaaaccacactgggataccccttcatgtccacaaggatggctgtgatctaaaagtcaaatcgcaaagggtggcaaggaggcggaggaactggaactgtcctactttgctggggaaatgtgaaatgatgcagctgctctggaaaacactctggtagttcatcaaacagttgttacttaagctccagcaattccattcctacatgggtagccaaaagaactgaaaaatatgtcacacaaaacttgtacatgaatgcttagagcagcattatttataataacccaaatgtagatacaaccaaaatgtctatcaatggatgaatgaataaacaatatgtaatatagccatacaatggaatattagtcagcactgaagaagaataaagtattgaagaatcctacaacaaggatggaccttgaaaacgtcatgccaagtgaaggaagccagataaaaaaaggccaaatagtctatgaatccattacaggagatgtccataacaggcaaatccaaagagatgggacactgattagtggttgcctgggttgaaggttgggatgaaggtagaggaagaataaagctaagagatactgagattcttttggagggacaccaatcttctaagtgagactacggtggtgattgcaccaccctatgaaaacactgagaaagccttggattgtgtgttcagcttaagtggatgaattatataggacagtcacgcatcgcataatgacattttggtcaacaaaagatcgcatatgcaccagtgaccccataagattataaagaagctgacaaattcctaacacctggtgacaccacagctgccataatgtcatagtgcacggtgttactcatgtaggagccactggctgtacctatagcctagatatgcagtaggcaacaccgtctaggtgtgtgagtgcactctgatgctcacacagccgcaaaattgcctcacgaagcatttctcagaatgtatccccaacatgaagtgttgcgtgacaggatgtgcatttgtttcaataatgctctttagaaaattgaatgacctagcttatcacatgtgcaaagatgctcaccctccttcagtaaagaaatgtaaatttataactacctaaacactgtttgatttatcattgtagtagtggcagcaacagttgtggttgcaacagccaaggaaccaataataacgtgtggaaggagggcaatgagagaggaggagggacaggggaaaacaaggagggggaagagaagggaacggagggtagcagagggatcgcacagagctgtccatgtgttattgtgaagaccctcgtacgataatgattgaatgaaattgcagtgcctctttagagagcaattaggtaggatgtagcaacactaaaaggtacaaattctgtttctcaataattctacttcttaagatttgtcttatgtaatgtcgactcctgctaatgtgtagatataggcaaaagatttcattgcaacattatagaagtattagaaacacccttaatgtccctggacagtagactggctaaataaatgctgttatatctaatcagtagaatactacacaccttaaaaaattaaatctgattcatatatgccaatggaagagcctcataaatagactgttaaggttaaaagccacataagcaaaatgcaaataatattaccaattataaaaataagaaaagagaaataatcacacatattacgagtacattgttggaaggacaatttttaaaaccctcaactataaagaggaactaccttgtagggcaaggaatgattattttaattttcctttatattatttgttttcatatccctttatgccattttaattaacacaatgtgtgtatattaaccttcaaattattaaaacaaggcaagtaactgaaattaactaggagctgcaggcatgtgataatctcacggtaagtttggttatgtaattcacaaacaccttcttacgtgttgttctttgttttcatgtgaggtgtcttgtgacacgtagattttccagcattttattatttggaattttgttatctattatggataaaagtatgtagctttgttttcagattaaaaaaagtaactgtggttaatgtaagtagaatacacatttataagaataagacagataatcccagaattacagaaacttgaagatcaatgtttggcatcgtaatggaaactaaaagatatttgggtgctgaaatgctatacagacaaaacttttttttttaattttgcaaatatatattgagcacatactgtgttctaggttttattgcaggttctgaggagtcaagaggaaagctacccaaaccaaacgaaaccaaacaaaacaaaacaaaatccctggcttcaggaaagttacatttttgtgactatgagtccgtgtgaacattccctctgtgccaggcattgttgtaagcacttgagatgtactaacatatgattttcacaaccaacccatgaagttggtgccatctgagtagggcaccactgctctctgttggacagcaccaccccttgtcactggacatcactgctgcaccactgctgctgctgggaccaccctcagtgcacacatacacacacacttcatgttgtccccagggctctagaaccccttcagccatggaacaaattttaaaccatctcagaatgttttgcgtccctcgcttccaatacagtgcctggggtgggaacacccaattggcttcactcgctgcacgtccataacctgggtgctcagattgcaagagagcaagtgtctggcatcttccttttgcgtgatggtggggcagatctcaaaaagataagtagttgtaaaaagccaacattgctccaaaatatgttcctattggacgttaatattgtaggcagtcataatcctacatctattgaagcaaatggcaaataatgtcatttgaaagtttttatatgaaaattaaagggtgttgatacaaataatgatttaaagatttttaatatttgattgattttttgcatttctggtttataaaacaataaatacagcaacatctctttgaatctgacattttataaattctggaaataagaaaaccagatgagcttcttctcaacaattctgctatattgagatgacgccaatcatgattcattgcacacctgcattaagtgactccatgcaattaggccaaatccatctcaaaattatattttattagtacactcttcaaaaacttacttcctcctttggcaacagttgcttaataaaggtctgtggatttgagtttttattgctttcctctcagtgccatgccatgagacactccatagtcctggctgattctatcaccttcatgatacttgaagtattcacatttgccttcctttctaatggacaaaaggtatattttaggtcaggtgtggtggcttaagcctgtaattccagcacttttcgaggccgaggcaggtggatcatttgaagtcaggagttcaagactagcctggccaacatggtgaaaccccatctctagtaaaaatacaaaaaatagccaggcatggcggcaggcacctgtcatcccagctacttgggaggctgaggcaggagaatcactagaacctgggagacagaggttgcaatgagctgagatcactccactgcactccagcctgggcaacagggtgagactctgtctcagaaaaaaaaaaaaagaaaaattaattatttaatttaaaaagttacattttagcattattttgtgtcttcatggaaacttgcattgtgacattgaactataattatttttgagtatttctaaactcttctgtgaatttcagaatgtacgtaaaataaagacagatgacaccatcctattcacatatgaagaatgcaatgccatttttatggataactgggatatttacataatttcaatgacatattttgccgagtctggccttaagacctgaaaaaacagcaaatattattgacctctgaatatagaaaaaatacataaatgttttcagttagttttgtgaaaacacctataactataaacgaaagtcaggatgtatactgacccttttgcctttctcacattttaaatgttgagactctttcatagtattctccattattagtaggaaatagtcagttttttgtcccggtcattaagtggatattaaaaatctttagaaaagaatatcatttggtttcctgtgaaatggcaactccgtctgcttcttgaagagttcgtatccatttacaaaatttatcatatgtatttgtttaagcagagtacagtaacaacaaatttaatatttcctttatcttacagatcctttaaacccagatcaagactcttccagtcattaccacggcaccagcagtggctctgtggcggctgccattctggttcctttctttgctctaattttatcagggtttgcattttacctctacaaacacaggtactgcagaaacaccatctgtttgagaatgttgtgagtgtaaactatgggtttaaagtaatgggcatgctctcgtgctcacatgcacatgtattttatattactatgcaatgttctttttttttttttaaatcaacttttattttgagttccggggtacacgtgccggatgtgcaggtttgttacctagttaaatgtaagccggggtggtctgctgcatggatcaacccatcactcaggtattcagcccagcacccatcagctgttcttcttgatgctctccctccctccagccccccacaggccccagtgtgtgttgtcccctcaatgtgtccatgtgttctcatcgttcagctcccactcatgagtgagagcaatgctctttcttggactaacaatgcttatttgtcaagattttttgttgtcctttctgttgttttctgccctactttttaagcagaatacatctaagaaataagagaataaatgactgagttgagaaataatatgtttttttctttcatgttcaattgaaagatgaaataaaggattctatctctacattcaggctccatggccaacgatgagaacctttagaaggtatttcaaccttccagcaaaagggtgaacagaatgttctctatggccactttcaactctgtgaatctgtgattgatagatgtttcattgatttctttcttcaacaaatacaaatttagctctttatatgtagtaagcaatatagatgttccatctcttgaaaaagtgttctgaatacccatcaatttgcaaaactctgctaactgtaaaatgtcaaaacttggggacaaacaactttagtgaaccagatcctttccttgggattaatgtggatgccagaagaaaagaattattttggaggaactataaactccttgtacattttttccatatatggataatacattacctggaggaatctggaaatgccaaactactctaaaatactatttgaaatggtagcattaactacaaataataagaaataaattatgatcccctgaaataaaattagataggttaaataaatatcagtacataatacagatatttcacttaattctggttaaaacagaaaaactgtcatgatattattttttcaaaactcatgaaatagcctctttaaatatttgctttcttatattcacttttgaaatacacagtagagaaaatgttgcttcaaaggtgtattagctgcttgtgcctgtgtcttcagttccctatggctagtaatgttctttctttaagaatatgactcaatgaaaaacatttcagatgatatttagaaaattaaagatgggcacatctgtgttaattttttggaagagaaaatacccaatacacacaagtccgatgagccttatccttgaatttctgctcaggactaatttaaaatttagtaaatgtagaaagatatgccactaccttctccaataagatgccatgatcagatgagcttctcttcttaaagggatatacacaaaaatgtatcttctttcacgggttcctctgggtcatataatatccttatagagacacatatgtaggaacttacaattcctacaaatttatttttgcttttgattggcatccacattaaccccaaggaaaaggtctagtccattaaagctgttttccctcaacttgcctgcaaagatgcaaaccttcatataagactgggattgtcttgtcctttaaaaagataaccccacataattatatatgcatatttatacataaatatcacttctgattatatcttaactttaaggcaatgtagcattgggggctatatccaacatacacaccagttttagtcgttaaaccttagaaacttccctgtcaatgctgagtagttgggtgtctccgtgaaggcggtgccttggaaagagatctcagattacagagccagagataagggagatagcgcttatttttatgtaaatgtgatgcctcctctgggtcggtggggaatctgtcgtcatcacaactggactccctcccttcctaacactgcaccaagaccaagaggctgccctgcatgttgaatatgaaggaagctgttccctctcacagttctcaagaggacggctatgaggccactgtgacttctcaatccattgggtcttttagttctctacttctgtgccataggagcgagggatggtggaatttttgtagaagcaaggaagcccagggctcagttgccagcagcacatcaatccattttcttcaagttctcaccacctggtcaggaaagcaccaagcctgtagcactctctacactggcttctcaggctctaaagagataaatatttcttgatgagttggctctgcattcctccagaaaaaccctgtttctgctcatttctgagtctgttgcttgcatgttgggagttgcttcctcagagcccaaggtgctgacagccttctgccgggtgcagctgcacacctgcacgtcagcatccagctgcagccagttccactctgggattgcatttccctacacatgaagggactgtggcagcttgtgatctggacgattgagtgaacattttagccaggtcttcacttcattgacgaggggctggatttgtttgctaacgatcactgctggcgcatgttccaagcacaatgtcacggacctctcccactccaagggcagtcacaaagtgctgttctgcctttttctcagagccatgtgccacgtacttctctttttcttaatgagcatgtgtaacataaggaaatctagtaaatgtctcggcagaagtttcttgacgcccaatgtcaaatgatgtttttgcgagcgtgcttatgtacattaaatttctggttttgccacgtggcacatttttcttacctgatttcttctggaataaggaaagaataaacagagacagagcagaccagacatgattctgtcttttcagtctgaaaatcctctaattctctaatcatagattgtacgtaggggttttcttttaaccagaaaatgtgacaacagtttaataatgagtatagttccttttttataaagattcatttttaactcaacagaggcaaaataaaaaataactttttgtgaatattagtaacgacagtgaactaaaagcttaaacttgaaatttagtgtaagcataccgtgctaaaggctaggcatatgcccacaaccctgttttacagagtagtagaaagtttcgtgtcttaaccaaggccgtataacttatcagtgataaatagacatccaaaacaaaaccaatccgattcagcctttgggaccttcccgatttccctggggcatttgtaggaagcataagtaaatctttgatcccagttacccaggaggctgaggtgggaggatcgcctgagcccaagaggtcaaggctgaaatgagtggtggtcgtgccactgcactccagcctgggtaacagagtgagaccctgtctcaaaaaaattttatttaatttttgaaatcgattcactttttaaaacccattttatactcccaatcaccaatttaagcaaataaactgacaggtgtgcaggtgtggatgccttccttctttgcaaacgtcctggctatactgctccctgctctgtagacgttgtctcctgcacacagtcccagctgctaaatctgcaaatgaaaccaggattctaatgatttgttttctgttttccttagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaaataaattatttacacagggtttatacacactatccattgtatataagcattatttcatattatcaagctaaacattcccccatcagcttagttggagtgttagggaaaagtattcctagatatggcacagattttaaaaggaaatacagtattgaagagatttattttattattgcttcaattagctccatttacgtgttgaattcattgaagaggtccaatgagaaaaaaacagaagcctccttatttcacacgttttcctcctttagtaccatcctcatccaattactgtctctctgatactacttaatagcagggggtttgcagaaatttctgtttgccatgtaaaactgtgaatagtaatttattttagatagtcgatgaacttgtgggttttagctcacaatgcagccttcccttttgcagtgttttttttttgtttttttttttttttgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatgatatattttatacattcatttgttatttgtttcatgctttatgattccagatggaaaggtaatttcagtgacttttcaagtttaaattccattataggtaaatgataagttatgatgcaaataaaatctataagatccccagggcaaataaaaatcaaaacatgaagtagaagatgtggccgtgaggtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctgttcccatatccctgacctgctccctggtcaacgatgctatgaaatcctgaaatgacaggacatacatacatacaagaaaccacatatcaaattagatatgattttcctttgtgtgcaaagtcaaactgtcctagggttgccagtttgaagcatgttatttaaatgaaaaaaaaaatcagtgaaattctcgtgtgagaattctgcctagtttcttcctaaggttgtgtgcagtgttgaacggcgtctccgcaaggtgttggaggatctcattttagggcagtcaggagctgtgcttgctgagttaggtctagaagactcttccctgaaggcaacgggaacacgcgtgagggacgcgaccacacactaacagaggacacgtgcttcagagctgtttaaaactgctgcttgttttacacacacatcttgccttttttcaggctagctgcaataatttttttcttctgtaaaatattttgtaaacaacaacaaaaagctattataaaaagggggtaaaaaaaagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttctatttttctgtgtgaatttattttcactttaatatgcgcacctgagtcccttgcaggggagggaaggaatgggagtcttcataatgagcctttaggatattcaaaatgaagctccatatttttcccacgacattcacatcatcgtcatgattaatcaatagcacatttagcaggaaccatgagacacagaatagtaacgttgaagctgacagatttcttgatggttcacattaaaaacggtaagaaaacttggtttcctccaaaccaaaacctatgtttttttatgatttcttttcaatttgggagctctgtttgtaaacgttcaccacactaaaaaaatgacatgaaagagaattatagacctacttaacagagcactccaaataacacatttaaagaaggctcaaaaaaatcaaaccgctttttaaactcagaaccagcggtcccccgttcatttctgggctgacagaaaacacaatgctttacacgtccttggtggcccatcacgccgaatgtcttgcagttcaacagaatgatacactactttctctgagagtcaagttattacaaaatgaaaaacaaccaataatatttccaaaatagcccacggtggcttcgcagcgaccaagttttgatgtccaacttgcaatctgagtcttgctggccagcaactgcatttaggtgccatttattgaggaaataccgagcgcgagacactgcactttgtgactcgcagacgttgcaaaacccccataatccaaccgagagggttttgccactttgataatttagatgaagaagcaggaagttaaataagttggttggtttacccaacgacacacagataggcagagctgatattacaggtcaggtttctcttgcttcaactttctcatttttcaagaaaccgtcacattatgaaatgcatccaatattccctttcttatccaattttttttctgaatttttctgtcattctacctgtgaatcttcttttgcttcattgagtaaataattaccaaagctaagaattcaaagggaaataagtactctctattactaattttcacattccacagaatgctcatacataatacacccttgtgagttattaacatattgagttgaagctttcgggggcagcaagaaagtagtgatcccacagtgtgtttcacgctacggttctttaaaataataaataaaatctgtcttgctctgtgcctcggtttgagtgctttcctaaaaaatatggggcttctataattatttgatgtattaaaggctgcagaataggcgaccgtgttaccatccacagcacggacatctgtggctattgaaacccagtttgcgtcctcttctcctgtgggactggcacctggagtttccctgggagtcactcctcctgatgacaatcagctttaatgagcattgctcacaattcctcgattgtccccgactgggcgtgggggaatcacactcatgtggttgagctgggactgactcctctcccaggaatcggggcctgacctgcagggtcaggtacatctggctgaatttaccctcagtccgtcaacccactccctgccaggaggtcagtctttcattccacagggccacttgcattcccacgacctgctcaccggccttttctcttaattctgggagcaaccccatatctttctatacaattgtctttttttcttcaagttatccaggcttagtgactgttacttgcagttgaggaactagacagccatagttacaacgtagactgagaaagaacctcagagattcaccccggctcaccaagcctctgtgtggccaacaactggggctgcgcacttcaaatccactgccctgcaagcgtgaaacaccatcctcagctctgctgtctctgaatataatgacaaattactgggcctaaatgacagtcacaactgctcagatggctgagagagttgctaaaagcctcctttgctgcatttaatcaaaacccttcagaggggttgaatgcttccaggggcatgcacccaaccagagggcctggaagccagtggctttcaacaagcttcatgttctttggaggatgacggacacccactattcactgcttttcacgactaaaatatcttgggctaaaggacagcaagaattgttttgcaatactgcttagaagacctgttggtttgcttgttttaaggcgttattcttttgtggatatcacagcaacttttagtttatcacacagtttctaaagggaaagtgcaagacgactcactttcctatttttttcaggctgtgtggaccccttagtccataggattatgtataaatgaagtatttaattggggctgggcgtgcgggctcatacctgtattcctagcactttgggaggctgaggcgggaggattgtttgagcccaggagttcacgaccaacctgggcaacacagggagaccctgttgctgcaaaaaaaaaaaataaataaataaataaattaggctatcgtgatggcatatgcagtcgtggtgaaatgcaactgtttttccaacatcttaggaggctgaagtgggaggatcacttgagcatggaggccaaggtcgcagtgagctgagatcccgccactccactccaacctgagcgacagagggagaccctgtctaaaaaatatataaaaatgtacttaactggaaaggataagacttatgccacgggaattacctgacatttcttcgcactattagtgtgttcaatgatttccgagcattaaaaagccaccctgcatctggaggtctggggcagcccaggacagcactgctgtctgtatcaggtcctggctatgttggcggtgccttccaagcttggtgcatggggtggagctctgttttggatgctgtcctgatagactctggtgttcaattctggccaaccttcctgtcctggcatctcaaagaacgtggacagtatagatccacttatcaaaatgattaaaaatcacattgtgtgttgcaaagggatgcatatatatgtaatccagttattagaaatgcatagaacgaaataacgtcatattcagattagtagtgactcctaaggtgagagaatgggtaatggatttgaatggtgctacgtggagagcttccaagttgtctgaaatggaaacttgggaaagctatttagagacatttaagatggataggataatattatctacctcatggggttatagagaaagcagtgtgcaccaggtcatgatttaagcatttcacgtctattttcacattctattacccaatttctctctttctcctctttatctatcatctatatatttatcatcctatcatctatcttctttccatttaacacctatctatcatttgtctatttttctatcatcctattgtttatctatgtatctatcagttatctatcacctttatttacttccaatacaatgtgaagaaagtagaaaaaagttttaacttttacaagttgtacaagtacctacatgttgattttttttttatttccataggttattgggggacaggtgatatttggttacatgcataagctctttagtggtgatttgtgagattttggtgcacccatcacccaagcagtatacattgcaccttatttgtagccttttatcactcaccctctttccacaccttccccctgagcccccaaaatccaatgtgtcattcttatgcctttgcatcctcatagcttagctcccacttaggaatgagaacatacgatgtttggtttttcattcctgagttaacccacttagaacaataatctccaatctcatccaggtcgctgcaaatgccattaattcattcctttttatagttgagtagtattccatcattcatatatatatatatgtattcacagtttctttatccactcattgattgatgggcatttgggttggttccacatttttgcagttgcaaattgtgctgctataaacgtgtgtgcaggtaactttttcgtgtaataacttattttcctctgggtagatgtccagtggtgggattgctagatcaaatggtagttctacttttagttctttaaggaatctccacactgttttccacagtggttgtactagtttaccttcccatcagcagtgtagaagtgttccctgttcaccgcattcatgcaaacatctactatttttttgacttttttttattatgtccattcttgcaggagtaaggtggtatcacactgtggttgtgatttgtacttccctgatcatatgttgattttttatactctatgccataatttatatttgaaatacattatattttaaattatgaaataatgagcattgaagtcgtttgggtttttttgtttgttttgttctcttttttttttttttttttgagacagggtcttgctctgtcacccaggttggagtgcagtggaaccatcatagttcactgcagcctcagtaccctgggcttaagcgatcctctcccctcagctttcccactagttgagactgcagtcctgccaccatgccaggctaatttctgtattttttgtagagatgaagtcttgccatgttgtccaggttggtctggaattcttgggctcaagtgatccaccctccttggcttctcaaagcactggaattacaggtatgagccgctgtgcccagcccgaagtttttattccttgctcgatgtcctcctatctctgagacctcggatgatcatagaaccattcttggatcacaactttccaagctgcaagttggagatatcaatatctggttttatttgtaaagcgtgtgccctttgtaaataatgttggctcatgaatatttggtaaaaatcattggaaacgattcatattttagcatagtttgacaataacacctctgactgcagcccctttcttctcctctaagctgtgcttgtttctatcctatgtctgacacattatgcatgaatacaaataaaattaaatcctgtgttgaaaaaaaaaagtgggacctgagtcagtggtagagtctcaagaagttctacctaaagaaggcttctgtgatataagaaaatgaaactgctgtgcaagaggatataattagaaataatttgcttacccacaaggatttggctaaacaacagaaaaatacatcagaaaatagttcttttgaatgtaacacaggtaaattcaggaagcctcaaagtctaaggttttatttacgtttgaaaagtttgatggttggaaaataaggaaaagaaaaggaggtttgcatttcctatacgtactgaatctcatgctgaaggagcaaagaaaaaaataacaaatgcctagactaattatttaacacagcaggccacattgacctgaaagatttatatgggaagaatttgttgaaataactttaatcctactttctattttggacacaagtgcatctggaaaggtaccaacaagacaataagagtgaacatattttgaactgcttctatacgcgagacagtatgctaactgttttgcactattttgtgtttcgcacattattgcctcaattaatcctctcacgtcacccttatgagcccaagaaatgagagacattgtgatagattccacagggaggaagcataaaatgagacctcaaacccagccactcttgctctcgaatgcctctcgctaagttagaattttcccaccatattcacacagtccagcccaaggctcatcctcagcccagcaccctaggcagactcctgcctgaggcactggggcccctgcaaggtcgcctggtctgtcggttccgcgcctgctccagttctgctgatgaggtgctccctgtggccatctgcaggggctctgggactgcatggttaacttggctgatgtcattgactctgctcccatgacctttggcctccagagtcaccttttgttctataggcctttaccaccatcctgtttccacctggtgtcccagcttttatttccagaccatcttatctcataatagaaagctcacgatgaaggtcttagaatctgcctcgcagatggagtttgaatactgataggtggaaagtcaaggacttgtataactttccagaattcatatgagcccgttattcttttttaccacattaaaaaaaaagacagaagagtacatgagggaaagaaaatgtcatcccagaaaatgtcttgaattcttatgattctgagatggagattaccaagacgatttctccctgtattggtaagaacctaggcttaagaactcacagttttagcgtcttctttagaaaccggagtcgatagaaagggagatagcaaggactccagggcgagaaaagctcttgagcatcagcttctgagcttgaaagggagcattagggggcatcctctgagtgttctgcgatcccatatctggcttttagagatacatctgcattgtctcaattgattttgttagcaaccctgtggggctaggtactattaataaccttaatttctagaatagaaagtaaagttttagaaaggtgagttatcatgtctaaaattatagaaattgtctctaagatctaaactacaaaactgatgaaagaaatcaaagagtaactaaataaagatacattccttattcatagataggaagcctcattattgtcaagatgtcaatctatagtgatctatatttaatgcaaattgatctatatttgcacatctaaattgatgtatactaaatatgattccaatcaaaatcccagtaagttatatgtggatatcaacaaactgattctaaagtttatacagagaggaaaagattcagaagagccaatacaatattgaaggagaagagcaaagtcaggccggttgcggtggctcacgcctgtaatcccagcactttgggaggccaaggtgggcagatcacgaggtcaggagatcgagactagcctggttaagatggtgaaaccctgtctctactaaaaatacaaaaaaaattagctgggtgtggtgggcctgtagtcccagctactcaggagactgaggcaggagaatcgctggaacctgagaggcagatgttacagtgagccgagaatgtgccactgccctccagcctgggcaacagagtgacatttcgtctcaaaaaaaaaaaaacaaaaaaaaaacagtcatgttgcttcccaaaccagtgaggccaaagtaaaactgacactgtctctctacatatgcaattttgaaggcagtttggaaacatgttctgataatcataaagtattcatatcattgacctgttcagcgctattgatgaaaacaagttctaaataacaaatctgaaggaagaaaacagaacacaagtctccatactatgtagacagatggatcgatactgacagatatagatatattgatatattactaaatagtaaacattaatgaaataaatattttgagagtagaaaaacatcatataatttaaagtaaaatgagagacagaaacaccaggcattcattacacattaaatatgaagaccatgtagcaatggaacataggtaagaggtactgtaaaatttagaattgatttgtttcacagtcatgactggaaaatcattgcatgaccctggacacagaccaagagaaagcatggacaagaagcttgctggatttattcaggggtagcaggttatgaatgggttttatttccttctttatttcatgtttcttcaggttttctgtaatgtcttgaagaaaaatgagaaaatttggaaaaaaataaattgaaaaaaataatgaaatgatcatctttttctactaccaaatctacttaaaacacctcaaaatttgacttttagtaaaaatcctgcccaccctccttcctcctcaggcgactggaataatcacaagatgcacatttgtaacacatcttttttacttagaggtcgaattaaaattcacatgaactgactcaggcttccaagtgttggaatactgtggagaaactggaattttccaatatttctggtgaggatttaaaaaatgttgcagctactttgaaaaacactttgacagtttctaaatgagttaaacttatcttcaccagccattccacatccaggaaagaagtaattgttatgttgacaaaaaagacttatatgtgaatgttcagggtattttctgtgatggcctcaaactggaagcaatgcaagtgctgacgggtgaacggataaaggaaatgtgttatatccacacaaccacacatctactcagtaataaaaaggaggaaactacgaatagcatgcagctataggagagaatctgaagagcaatatgctaaatgaaaaccaagcatgtaagactccctattacatattcccatttatatgagatttctataagcttcttattctttttgattgatagacatcttctgaacttggttttgatagggtttcacaattggaaatttactaaatctcattgaactgtacattcaggataatctaacaaagtaagtttaccttaataaaggtaaaaagattttaaaaatctttttaaaaatcagattaaaaatcagataatacaaaaaaaatctttaataaagcttctgaataaaattaggtaaacctttttatttttttatttttattgttattatttttgatctacactggcttgactttcttgtatgagaggcaatggcagcaagaagtggcaagtgctaaccagtgtggatgatgaaggccctcctattgcagtagggcttccatgctcagttggagggtatcgccttgcttagtcaggagcatctgacttggtgtgtcttcttcagcaaccaccacaaatggctaatttgacatcagtttttctatagaattttcccacttgagaatgagatccagcacgtaggattactccctgtgaattcacagctatatttgtaagtgaaaagctgaatgtataatgttcaagccactgtcagacagctggtgttctcttagatcttcggacaggtggtggagttgccgttttggcacctctgtcgttccgtgaagtttgactttctgactgctcacgttgcatccacgtgggaaggaggacgtcaacaataggtagacagcgagcagcatctgatccagctcctggtggagacagcttcctcctgtgcagttcctggagatcatgttataactgggtttgaatgtaccttcagggaaagtgattcaaacaagctttattatgggatggccttccttgggtgagcttagtgagatatttttgcagtgagagaagaaaggattcttaaatttttcttgtatgaaatgatccaaatatagaaaagctacattgaagcatgtgtattataccaaaaaaatgctcctaatgaaagctaaaaagattgaggtgatacaaacatcttgtatacacatttacaatgtttttcctattggaatggctcaactgacttttcagaaaattagaaatgcagaagaagaggctgttagattgaaggaattattattacttgtttgtaaactcactgacctcagccttgatcccttcatctttctttaaaatgccattgactatttctgaaaaagaaaaaaaaagatattatctcctgtatgggagagatctggcgtcattttttggctgctcttgttaatagattgtaataaaaacagcattgatattttaacattgtgcaggatcaaaagttttttctctgaaacacctgactctgtaaggttccacttggttaatattcacttagatcctcacaaagactcatagccccaacgtaaaatgacttacctgataactcctcaattacacagattctttgtgtatgttttcttttttaaataaccaaagaaaacctgtccatattcaaatcttgtataaaccacctaccaccctaagatcttctttacacaaataactgtggaaaataatctccctctatcttggtgtgtggtggcaccagatgcgttaaaccctccaggaagagcttcaacacagatcgctttgtcagaaaagagtgaaagtctttaaagtaattttttaaaagccaatatttgctacacaaagttatttatcacatacacacacacacacacacacacacacaccacacaacacaaaccctttagtccattctatgtaagtgttaaaggaactaaatatggcttgggcaggactctgtgcttctatatttgagtccttgtggacgacctgcaacctagcttaataggtagacaagactgaaaatcttaactccagttcaagtgattctcctgccccagcctcctgagtagctgggactgtaggtgcatgccaccacgcccagctaatttttatatttttagtggagatggggtctcaccatgttggccaggatggtgtcaatctcttgaccccgtgatccacccgcctcagcctcccagagtgccgggattacaggtgtgagccactgtgcccagcgtatgtttaatatgtttttaagccgtcaagacgaatactcaaattttgcatctagtcatgtttttcaaagtgtaagcccactaccactcctggaacttgagataattttagatcttacatgggtgaacatttgtaataattttatattttaatgtattggaaaatgtaagtataagcagtttaagttgaaaataatgtaaaatgaattgatttaggttaaaaatgttggtttaaaattggtaagaattaatatagcaaaaatcataaaaataaaactgaatgaaatttaaaaaaaaaaaaagaaaagaaaatctaacttaggagcatgtccctgtaacaatcgctaagacttggccagtcccagcagccataattcaaccactcatacacttctgagtgttcaaaccgtgttcaaataaggcaaatgccaaactgtaaccaatctagctgttctgtacctcacttctaatttatgtacatcatttctcttttttttgtctaaaatctccttccaccacgtggctgtgctggagtctctctgaatctgctgtgattctgggagctgccttattcgcgaatcgttctttgctcaattatactcctttaaatttaatttggttgaagtttttcttttatcataggtaaaaaaaaaaaactctcacaaatccactaatgacatagattttatgctataagctgttttgaaaatgtggatatgagtttttgattgcttggtttgctatttaaaaagttgaaatgtcttgccatatgcaacgctttgatttagaatcttgcaccgatgagaaaaagaatttgactgacccaactcgacctcatcatccaggaatctcctggttgcatcttggtcacaggtcacctgtggaatgataaattctatatgaagatctgattagagatttgctgatgtgaaggacataccaagaaaattcactccttgtcccttccttagaaaaatcctcatccttcctagaaaaatgcctgagcatctcagtcaggcctgcattcgcattgtggtcccttcttcttggccgtaggcattgcttcagggatggattggtgaccaaaatgaatacagggggaattctagaccttttctgtaaagtttgaaaacaaaatattctcttttctctccacaggcagctcgagggatatctctaggagactcaacagccacctgctcaccacagtgggagggagtcagggtaagaatgatcagcccagaggcaggggagctgatggtggtctcagttctggagttctggatccaggaccactcctgtctatgagatggtgaggttccatgtcttgctagcttattgtgggtggtaattttctattacttgaaattagaagattcctaaatgatacacacagcaaataacttgaaatagttttcctgtcttattcaattgtaatacagagctttatcatcattatacaagttattacgtatatttttagaaacacgaaaattgtctgtggagaatatcaggtgaaaaaagtggtttgacaaaaattggaatcagtgttagattcttggaaaagtctctccttctgtaagttttctgtggcctgagtccgctggccttgacagaaaaggataaatgttcctcttggaaagaacactaaaagctgaagtgaagacctctatttatttctgtcttagagagaaattttgagtgaatgttcaataggcacttaaatttcaactttgctaaaagtgatgtttacagcaaagaatgattccttgcccattttatataacacaacctaaatagaaggctgtactggggaaggcggattacttaacgtccattgcccagatcataaatctccactaaagtcaaacagtggccacaaaaaggctgtgggtaataagaaacaggggaatccctccagcagcctcatacctcatcgtgaaataaaaagctcaaagacatacgtgatgagcagctctagcaaaagatgacaaagtgatttcattatctgggtagcttagcaaatggtccataccaagtggtacaatctttctcctactaaagaaaggctccttgttagagcggagacaataaaatgtcactatacatcattgttgcttcttaactgtcactgtgggtggtattgctttctctatggttaaatgtaggcgaaatgactaagacattcaagcaaatactaatgtgcaggtggatattttcttgcttgttggcctacacattggaggtccctggtcgtcttagtccactggggcagctataataaaatgcaacagaaatggtaatttgcaaataatagacatttatttccatagttctggaggctgagagtccaaggtcaaggcacaggcaggtttggtgtctggtgagggctgctctctgcttccacagtggtgccttgtggctgtatcctctggagaaaaggaatgctgtgtcctcacatggcagagtacatgaaaatcagaggcagctctctgaagcttctttttttttttttttttttttttgagatcgagtctcgctctgttgcccaggctggagtgcagtggtgcgatctcggctcactgcaaactccgcctcccgggttcacgccattctcctgcctcagcctcccgagtagctgagactacaggctcctgccaccatgcccagctaattttgttgtatttttagtagagacagggtttcaccgtgttagccaggatggtcttgatctcctgacctcgtgatccaccctcctcagcctcccaaagttctgggattataggcatgagccactgcaccccgcctgaagcttcttttataggggaattaatcccattcatgagggtgcaaccttcacgacctaattgcttcctggagaccccaccttccactttctaatgccatcaccttagggattaggtatccacatttgaattttggagggacacacccattaataccatagcagggatgatggaagaagtcaacctacacttgagtagtggttacacagtggtactgagcaccactgtgtccagctaggctgaagaccagcagagcatctgagacccacttgcatgcacctgcgtcagctttctcacgccctgcatcacctgcccaaggacagccaccgtgtcagcatcactatccccattccctcctcattcccatggccattatcctagctcaggactttatgctatcccccagctcaagcactgtaaacgtttcctcatttgtctcctgaactattttcttcccttcaatatccaccaactcactgaagctatcaaagctttgttgtaattaaaatctgagtttgtcacccactagttcaagatccttccatgactctccactgctgagccatctgtatttctcctttgcaagcaccataatactaagatttttattttgctttttgtctgggacagggtctggctctgttgctcaggctggagtacagtggtgagaacatagctaactgcatcctcaactttgtgggctcaagcaatcctaccacctcagcctcccatgcagctgagaacacaggtgcatgccaccatgcccagttattttttatgtttatttttcatagagacaacatggtctcatttttttgcccaggctggtttcaaactcctggtctcaagggatcctcccacctcagcctcccaaagtgttgggattacaggcgtgagccaccactaaaaatttttgttccaattttgtcggttttttttttttttttttttttttttttttgagacagagtcttcctctgtcggccaggctggagtacagtggtgtgatcttggctcactgcaaccctgccaccttgaaccttgaacgcctgccaggttcaagtgattctcctgcctcagcctcccgagtagctgggactacaggcgtgtgccaccatgcccagctaacttttcgtatttttagtagagacagggtttcaccatgttagccaggattgtctagatctcctgacctcttaatccacgcacctcggcctcccaaggtgctgggattacagacgtgagcaaccgcgcccgacccaattttgtctttttaattctggctggattggaagttctataataaaaaagataataaaaaagttataataaaaaagttcttgagtatcttgttcactgttttagcccaaaacctcatggagtccttaactcagaatcgatgcccgctaatcacttggaggataaataaggacgctccatgagacacaccacaaaacaacttgcagactgttttcattctctcattaaaacatgttaattcttcctataaagcctggtgctagcttttaaggacacaggtagacgagatgaaccaagtagcatgaagttcacattgcacctgagaaaaccagtgagacacacattctgccgtggcgggcaatgaactcataaaaattgaggtggacagggaatgaaacagccaggtaacttcattcttgtcaaggttcttgttctgctgcagaacaaacacttcaggaaagccaccattcctcaaggcttcctttgaattgtatccacaggtaaaggtgttgataaggcactagaggcgtcagcagacgacactcttctaaaacatctagggctcccgggctgatactctgggcaatcggtttctgttacattctccttctctcttttaagaagttttcttcacgtttttagtcatgtgagacattgcgatgccctcagataaaaggaagtcagaaagcctcggagactcggatgatatgtgtggctctctcaagcttgtgtgtgaaggcacatgagctcttgttgcttcttgagctctgagatgatggggtcgtgctgctccaacaggcttcagtcctgcgacctacctgggtttgtgtgttcctgcaccctaggatctggggctgagaagggccggtgggtgggcacagggcaaggatgtctaaggaccctatctgtttccagtttccccttacactaaactttctgttgcagctctttatttgtttaaaggggagagtgcctgggagtcagtgggggtgttagaggagtgaagcttaggtgtgaaggttctgaggtggaaacatcctgatacttacaaagaaaagaacagaaaagaaaagaaagaaagagagagagagaaagaaagaaaaaagaaaggaaggaaggaaggaaggaaagaaagaaagcaaaagaaagcctaaaactgaaatatgcaaatgctgagggaattaggagctacaagagctggcgagatgggcaggtccagaccacaggggcccctgagacacttgttagagtttaaaatgtaattgttcaatgggatgcatttagtgaggagataacaaagttagttacaaaataataatgagtttggagagaatacttagaaaacaatgtcaaggtcaaggagcccatatgacagaaaaaaaacacagaagacatgagcacacactatccaaatgttgccttcattttgactgaaggaaagaaggaaaggcaggaggcagctgcacttgtcacggcggcagtactcactgttaatttattgttctcagcccccagtctgcctcccgttgcccgctgtgggattatggtgttgcatgcgctgagacttccttgccagccggcacactgttagtgttgtgagcccaggggcctgggaggatgctgcaggagaaggagaaaggggatttcttcctgagctcttcttagaagaggcctgcagcgtgcacagggtgctcaggaatcggcgtccctccctgtgggcccctgagctcttaaaagaggcctgcagtgtgcacacggtgcccaggaactggagcccccctccctgggcccctggagagcttctggggtgtccccagcacagcggccacctcagccaccttttctgtgtcctctccaatgcaatcactgcctccgccctgggaagtggctccttctgatttgtcagggagggtattgcctcaaccttacaggtattaatgagcacctagatctgttctctcttcctggatctgtctgaattgttttgctttgctttgtttttctccctagcaagtaatcctcttcataggtaggaattgtttatatgaaactttttcctgtgtggtgctgtctcctgacttggttctggctcacacatcagtgttgaacttaccctaagttccaatcacaagtgcctgttttctactgacacgccaattagccccagcatttataacattgttataagaacaaaaacatgcaaatggagtaaaaaccaatcagaaatgtagcagcaattgttctagctagtttcttcttgaaggaaaatagaaggaaaagcctgagagattttgccacatacatgaacagaggaaatgagagcaaggtttccaaacattttgtaaaccctcagttaactgcaaagctcaagagtttcttagtcggaaatgcttgtgtttccactggcacctcttcagacacagccaatgctagggcatcaaatagtcggtgattcacgatgtctcaccttttaaggtatcagcattccttctgagaagggagcttgcttgaaaaatatgagcactcacaaatactttgggagttgcaattaactatgtcttattgtgtctttgctttcttcccgtagagggggaagtgaaagtttgaagaatgaggaaactgctgggtgattttaaccaggagaataaaacgatccatgtgggtttttatacaatgatcatctattcacctattctgtgaaagatttgttagttggggacattagcagtttccgaaggaacagttagcagaggcaagaggttattctattcagaccatggtaactgagaccaacgatacagaagccacagcataaacatgtttttttgttgttgttgttttgttttgtttgttttttctttcttttttgaaacaaaacaaaaaagcaggaatcttgctttgttgctctgtctggagtgcggtggcacaatcacaactcactgcggc

SEQ ID NO: 1778 - DNA, 54768 bp, Homo sapiens
  RP1 gene - 55691180 - 55705947 of chr8; NCBI Entrez Gene ID: 6101; Build 35; sequence includes 20,000 bases upstream of initiation codon and 20,000 bases downstream of termination codon of the gene
aaaattcttgggatatatagaatgctattttatttaataattctgtttctccataagactataatagacttcaagagctttttcattcttgtcctatgcattaatcaggatcgctgtgaattttaattcagagtacatttagatcggtttcatctgttcaacaactgatggaaatgtgaaattccattgtgatttttggggtacacttgttacctcagcataacctagactctcttgtccattataggccctacctatatcacaactgtaaatctacaatttctggagtttgtttcattgcatgaacaataatattcacctccttcacaattctttgtctcttagctatcccatgactcaaattatctcctctacatgaatacctttcaaatcttctcttattctgatccctctccaaatttccaatataagattaataactttcagacatcaccacctagatgtctatgacctcaaatctgttacaaataggatggatttacccaactcttgatttaacattgtttttgacacatgttgtctgtttttgttagtggtaccacagggttgtaagacttgagctccccacttaaacaaggacagagcaagtactcagtaagagccaactcttttcctctgtgatactcctgctctatgcagcttttgctgaactatgctctgtgtcagattatttaattacgatacattattcatttaaaggattaaataaattacccatctccttgccttctacaaccaatctattgttatgttattttgggtccacctctgaaattttttggaaataatttccttcctttctattcctattctcattactctaagtcaagcccttatgaactctggatttcactatttttagagctaccttaccggtttctgtcagcactgtgtcctccctccaaatcatttgacatagcaatgtcaaggacatcttcagttctgattatgtcatttccctgctcaaaaaccttcagcatttccatgttcaatagaatagaactaaaactccttagcccggcattttccatctccacagtatggtctccacacatacacaggcttcaatgttagatggagaatactactgcaaagtggttaagagccttcattatttactaattgtgtgacctttggttaattactactccctcctcaactccagtttttctacttggaaaaacagggataataatagtacatacttcctatagttgttatgaggattaaataattcatttaaagcattaacatgcctggtaaaatataagtaatcaagacattttattattattattattacagcatttttagatgagtacataaatacatgttgtatatttatggaacttgatatcaattcagttcttctctttatatgttttagaaatgggaacatgagtctacaggactgggaattatggctccctcaccattcagttcccatgtatttctcattagcaattatttctagatgaagggctatgcctgttgtgctgtatggagcacactgaatgttgtcatgattacttgcctaagcaggttattaatgaaactcaagtttccactaaaaagaagcaatgtactgatatatgctaaaacatagttgaacctcaaaaacattatgctaaataaacaatgccagacaaaagacctccatattgtgtgtccatttatataaaatgtccagaatagtcaagtctataaagcctagaagatagattagtggttgctttgggctgtgggtggaaatgaagaatgactgcaaatggagacaaagtgtttttttttgggttgatgaaaatgtgtacatatagttccatgtcattttatcacatctgtaaccaccaccacaagaaagatgcagaattgtttgatttcataaagatcttgcttgagctacccctttatggccatacatttttccctccccgcactatcgttaacccctgccaaccactaatctattctcaatctctgtaattatgacattttgagaatattatataaattaaatcatatagcatatgagttcattaccaataatttaacgtaattattgatattctaaggtttaagtctgccatattattttttgttttctattttctctgatttttcatttctttctttcatatacttcctgtggaatactttaacatattttagaattctattttgattctatattgtttgtaagcatatctctttgtatatatttttagtaactactctaagtattaaattgtacatacataactatcagtctactgatgtagacattttaccagtgttaagtgtagccctttaattctctttaccctccctcatttataattgttttaatatttcctctacttcattgagagccacataagaaaatattatacttttgcttcaattgtcaaaaacaatttagaaaattcagatggaaagtttattgtatttattcttatttttgttctttctgttgtccttttttctttccttatattcccaaattccttcttttatcatttactttctgtcagataacttccttcagtcattcttttagagtaattctgctggtgacaaatattcttagttttccttcatctgagcatgcctttgttacctgcattcctcaaggatatttttgccggacatagaactgtggttgacagctcttttactgtagcacttagaaaatggttgcaatatccttcggagcttcttgacttttgatgagaagtcggctgtcatttgaattgtttcccccttttcccttacaggtaatgtgtcatttctctctggttcctttcaaaattattttcgctgtctttagttttctgaagtttgatgatggtgtgtcttagtgtaaatttctttgggttttttgtccttggggtttgatcagtttcttaaatctgtagtttgtttttgctaaataagttttcaaccattatttctgggaaaatattttgaggcccacctgcttcctcctctccttctgagatcttttgttatagttctgcaagtccctgaggttctgttcaatttttttttcaatctattttctctctgttgttcagattgggtaatttctattgtactaccttcaagataactatataattatttcctgtcttttccatgatgctgttgagcccactcattgtgttttaaaattttgattactgtagttttcatttccagaatttccatttggttcttctttatatcttctatttctaaggctttctattatttcgtttgtttcaagtccatttggaattgcttgttgaagtagttgtatggcatctgctttaaaacccttgtcagataattccaactctgtgtcatgttgatgttgtcatttgttgactgaaagtcttttttttttttttgagacagggtctcactctgtcgcccaggctggaatgcggtggcaccgtctcggctcactgcaacctctgtctcctggcttcaatcagttctcatggctcagcctcccgagtaggctacaggtgcacatcaccatgcctggctaatttttgtattttttggtagaggcgatgtttcatcatgttggccaggctggtctcaaactcctgacctcaagtgatccacttgccttggcctcccaaagtactggggttacaggccactgtgcctggcctgactgaatgtcttttgtcattcaagttgagattttccttgttcttggtatgatgagtgctttttaaaggttgcattccggacattttgggtactatgttatgagactctgggtcctatttaaatcttgtgttttagaagacctcctttgacactgctggcagaggaaagggaactcactcctctttactaccagatgtggatggaagctctggccacttacactgcctcatttgacatcctgaggaggggtacaccttattactactgggcagggatgggacttcaggctttgatatggtttggctgtgtcttcatccaaatctcatcttgaattgtagcttccacaattcccacatgttgtaggagggaactggtgggaggtaactgaatgatgagggtgtgtctttcccatgctgttctcgtgacagtaagtctcatgagatctgatggttttataaaggggagtttccctgcataagctctgtctcttgcctgccataatgtaagaagtccctttgcccttccttcatcttctgccatgattgtgaggcctgcccagccatgtagaactttgagtcaattaaacctctttctttataaattaccgagtcttgggaatggctttattagcagcatgagaacagactaatacaggcttcctttgtggtctcatttaccctgcagagtggcggggagttggggagggatttgggcagacccattactgctaaatggtggtgaaagttctggcttccctctgggcttcttctgatacgaataagagggagtgtggtggctttactaccaggtggagatggaagtcttggttccccacttggccttcactgatatcatccagtgtagggaagagagggatgcctcattattgctggagaagggcacaggtcgaggcttcccaaggcagataagagtatggtgaggcctgggtattttcctgtggtgtttggctgcattgggcaggtattgcctaaatgttttctgtcttactagcttgcccctttcctggacccttggccagagagaggtgactttcattggagcattttaaatctgctcctatcggtgttttttggtcactggcttctctagcacctagtttgggatatatgggacaaaaagaaaacccagagaacacactgctgtgtcattccttgagttttgtgattcctagccctcctgtcttcttgtctgtgtctttcagtgtatttgctttatatataatgtccggggttttcggttgtacttagtgagaggaatagggagacgtggtctcctccatttcggtctggactattctctgcaactaatctgaccatttcgttttgccattctgccttacaatgtaggagtattgacttacatgacctacaagtaacttgcataaagacatgaaaaggcaaataatggggtttatcaaagatacctctccactgttaaaaattaagctttgaaatcctatcataagaatgaatgctaaataaaaagaaaacctaaaatattttcaacatgtggatatgtaattttttttgaaagaagcgatattcacaagaacaaaaaaccaaacaccgcatattctcactcataggtgggaattgaacaatgggaacacatggacacaggagggggaacattacactctggggactgttgtggggttgggggaggggggagggatagcattgggagatatacctaatgctagatgacgagttagtgggtgcagcgcaccagcatgtcacatgtatacatatgtaactaacgtgcacattgtgcacatgtatcctaaaacttaaagtataataaaaaaaaacaaaataaaaaacttagaaaaaaaaaaaaaagaaagaagcgatagtaccaaagacttgcacaagaatgttcatagaagtattatctgcaggagccccaaactggaaacaacctaaatgctattcaaatggtgaatgaataaataaaatacaataaaatatttgaaaataataaggaataaagtactaatatatgctactacatggatgaatctcaaaagcactatgctaagtgaaaaaagccagccataaaagatcacatatggcatgactccatttatatgaaatgttcaaaataggcaaatccataaagacagaaagtagattcgtggttgcctagggctggtgtaggggtggtgggataggtacagtttctttctttctttctgaggtgttctaaacttagatcattgtaatcttggaacaactctgaatattctacaaatcactgaatcatccatttttttaaattatgctttaagttttagggtaaatgtgcacaacgtgcaggtttgttacatatgtatacatgtgccatgttggtgtgctgcacccattaactcttcatttaacattaggtatatctcccagtgctatccctcccctcttcccccaccccacaacaggccccagtgtgtgatgttcccctttctgtgtccatgtgttctcattgttcaattaccacctatgagtgagaacatgcggtgtttggttttttgtccttgcgacagtttgctgagaatgatggtttccagcttcatccacgtccctacaaaggacatgaactcatccttttttatggctgcatagtattccaaggtgtatatgtgccacattttcttgatccagtctatcattgttggacatttgggttggttccaggtctttgctattgtgaatagtgctgcaataaacatacatgtgtatgtgtctttatagcagcatgttttataatcctttgggtatatacccagtaatgggatggctgggtcaaatggtatttctagttctagatccctgaggaatcactacactgacttccacaatggttgaaccagtttacagtcccagtaacagtgtaaaagtgttcctatttctccacatcctctccagcacctgttgtttcctgactttttaatgattgccattctaactggtgtgagatggtatctcattgtgcttttgatttgcatttctctgatggccagtgatgatgagcattttttcatgtgtcttttggctgcataaatgtcttcttttgagaagtgtctgttcatatcctttgcccacttgttgatggggttgtttgtttttttcttgtaaatttgtttgaggtcattgtagattctggatattagccctttgttagatgagtagatggcaaaaattttctcccattctgtaggttgcctgttcactctgatggtagtttcttctgctgtgtggaagctctttagtttaattagatcccatttgtcaatttttgtttttgttgccattgcttttgatgttttagacatgaagtgcttgcccatgcctatgtcctgaatggtattgcctaggttttcttctagggtttttatggttttaggtctaacatttaagtccttaatccatcttgaattaatttttgtataaggtgtaaggaagggatcctgtttcagctttctacatatggctagccagttttcccagcaccatttattaaatagggaatcttttccccatttcttgtttttgtcaggtttgtcaaagatcagatggttgtagatatgcggcattatttctgagggctctgttctgttccgttggtctatatctctgttttggtaccagtaccatgctgttttggttactgtagccttgtagtatagtttgaagtcaggtagcgtggtgcctccagctttgttcttttgccttaggattgacttggcaatgagggctcttttttggttccatatgaacttgaaagtagttttttccaattctgtgaagaaagtcattggtagcttgatggggatggcattgaatctataaattaccttgagcagtgtggccattttcacgatattgattcttcttacccatgagcatggaatgttcttccatttgtttgtatcctcttttatttcattgagcagtggtttgtagttctccttgaagaagtccttcacatcccttgtaagttggattcctaggtattttattctctttgaagcaattatgaatgggagttcactcatgatttggctctctgtttgtctgttattggtgtataagaatgcttgtgatttttgtacactgattttgtatcctgagactttgctgaagttgcctatcagtttaaggagatttgggactgagacgatggggttttctagatatacgatcatgtcatctgcaaacaggacaatttgacttcctcttttcctacttgaacaccctttatttccttctcctgcctgattgccctggccagaacttccaacactatgttgaataggagtggtgagagagggcatccctgtcttgtgccagttttcagagggtatgcttccagtttttgcccattcagtatgatattggttgtgggtttgtcatagatagctcttattattttgagataattcccatcaatacctaatttattgagagtttttagcatgaagagttgctgaattttgtcaaaggccttttctgcatctattgagataatcatgtggtttttgtcgttggttctgtttatatgctggattacgtttattgatttgtgtatgttgaaccagccttgcatcccagggatgaagcccacttgatcatggtggataagctttttgatatgctgctggattcattttgccagtattttactgaggatttttgcatcgatgttcatcagggatatcggtctaaaattctctttttttgttgtgtctctgccaggctttggtatcaggatgatgctggcctcataaaatgagttagggaggattctctctttttctattgattggaatagtttcagaaggaatgataccagatcctccttgtacctctggtagaattcggcagtcaatccatctggtcctggactttttttggttgataagctattaattattgcctcaatttcagagcctgttattggtctattcagagattcaacttcttcctggtttagtcttgggagggtgtatgtgttgcggaatttatccatttcttctagattttctagtttattttcatataggtgtttatagtattctctgatggtagtttgtatttctgtgggatcggcggtgatatcctctttgtcattttttattgcatctatttgattcttctctcttttcttctttattagtcttgctagtggtctatcaattttgttgatcttttcaaaaaaccagctcctggattcattgattttttgaagggttttttgtgtctctatttccttcagttcttctctgatcttagttatttcttgccttctgctagcttttgaatgtgtttgctcttgcttctctagttcttttaattgtgatgttagggtgtcaattttagatcttgtcttctttctcttgtgggcatttagtgctataaatttccctctacacactgctttgaatgtgtcccagagattctggtatgttgtgtctttgttctcattgatttcaaagaacatctttattactgccttcatttcgttatgcacccagtagtcattcaggagcaggttgttcaatttccatgtagttgagcggttttgagtgagtttcttaatcctgagttctagtttgattgcactgtggtctgagagagagtttgttataatttctattcttttacatttgctgagaagtgctttacttccaactatgtggtcagttttggaataggtgtagtgtggtgctgaaaagaatgtatattctgttgatttggggtggagagttctgcagatgtctattaggtccacttggtgcagagctgagttcagttcctggatatccttgttaactttctgtctcgttgatctgtctaatgctgacagtggggtgttaaagtctcccattattattgtgtgggagtctaagtctctttgcaggtctctaaggacttgctttatgaatctgggtgctcctgtattcggtgcttatatatttaggatagttggctcttcttgttgaattgatccctttaccattatgtaatggccttctttgtctcttttgatctttgttagtttaaagtctgttttatccgagactaggattgcaacccctgccttttttggttttccatttgcttggtagatcttcctccatccctttattttgagcctatgtgtgtctctgcacatgatgagatgggtttcctgaatacagcacactgatgggtcttgactctttatccaatttgccagtctgtgtcttttaattggagtatttagcccatttccatttaaggttaatattgttatgtgtgaatttgatcctgtcatgatgatgttagctggttattttgctcattagttgatgcagtttcttcctaactttgatggtccttacaatttggcatgtttttgcagtggctggtaccggttgttcctttgcatgttcagtgcttccttcaggagctcttttagggcaggcctggtggtgacaaaatctctcagcgtttgctcatctgtaaagtattttatttctccttcacttatgaagcttagtttggcttgatatgaaattctgagttgaaaattcttttctttaagaatgttgaatattggcccccactctcttctggcttgtagggtttctgccgagagatctgctgttactctgatgggcttccctttgtgggtaacccgacctttctctctggctgcccttaacatttattccttcatttcaactttgctgaatctgacaattatgtgtcttggagttgctcttctcgaggagtatctttgtggtgttctctgtatttcctgaatttgaatattggcctgccttgctagattggggaagttctcctggttaatatcctgcagagtgttttccaacttggttgcactctcctcatcactttcaggtacaccaatcagacgtagatttggtcttttcacatagtcccatatttcttggaggctttgtttgtttctttttattctttttttctctaaacttctcttctcacttcatttcattcatttgatcttccaccactgataccctttcttccagttgatcgaatcggctactgaggcttgtgcattcgtcacgtagttctcgtgccatggttttcagctccatcaggtcctttaaggacttctctgtattggttattctagttatccattcgtctaattttttttcaaggtttttaacttctttgccatgggttcgaacctcctcctttagctcagagtagtttgatcgtctgaagtcttcttctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtgtttgataatggtgacaaacagatggggttttggtgtggatgtcctttctgtttgttagttttccttctaacagtcagtaccctcagctgcaggtctgttggagtttcctggaggtccactccagaccctgtttgcctgggtatccgcagcagaggctacagaacagtggatattggtgaacagcaaatgttactgcctgattgttcctttggaagttttgtctcagaagagtacccagctgtgtgaggtgtcagtctgcccctactggggggtgcctcccagttaggctactcgggggtcagggacccacttgaggaggcagtctgtcttttctcagatctccagttgcatgctgggagaaccactactctcttccaagctttcagacagggacatttaagtctgcataggtttctgctgccttttatttggctatgccctgcccccagaggtggagtctatagaggcaggcaggcctccttgagctgcggtgggcttcacccagtttgaggttcctggccactttgtttacctactcaagcctcggcaacggcacggacccctcccctagcctcgctgccaccttgcagtttgatctcagactgctgtgctagcaatgagcgaggctctgtgggcataggaccctctgagccatgcgtgggatataatctcctggtgtgccatttgctaagaccattggaaaagtgcagtattagggtgggagtgacctggttttccaggtgctgtctgtcacctctttctttgactaggaaagggaattccctgaccccttgcacttcctgggtgaggcgatgcctcaccctgcttcggctcatgcttgatgtgctccacccactgtcctgcacccactgtctgacactccccagtgatatgaacccggtacctcagttggaaatgcagaaatcacccatcttctgtgttgctcacactgggagctggagactggagctgttcctattttggccatctgccttttttttttttttttttaatttgagatgaagtctcagtctgttgcccaggctggagtgtagtggcacaatcttggctcactgcaacctctgcctcctgagttcaagtgtgaatcatccactttaaatgggttaattttatggcatggaaatcatgtatcaacaaagcagttttaaaaactagatggtcatgacggtatgttcaatgtaagggagcatatagaagccctctctgccctctgttttcagtctaggcagttatttgtgcctgactaaccaaatgacttggccgaaagaatagcatgagatggttttgcatatacactgactatgaaaaaaaagttggcttacatatgtttgttcaacatggtaaaaaaagaagggaggaatctagtgaaaattagagaactcctaggggatggacgatattgcagcaaaccaccaaggcacacattttcctataacaaacctgtacatgctgcacatgtacctctgaacttaaaagttgaagaaaaaaagaaaattagagagtaagtcttaaatatatttgctatcctaataacaatagtctgtatatactcaaatctttgcttgttctctcttcctttcaaataatacattaaaaaccatagtcttctagttagtaaagtgtatttgggctgagtttgccttccctctacatctaagcaccatgaagatgggggctgggactgtcttatctgtagtcacatggacaggatctgacagtagatagacatcagcctctttggttccggaggactttatgttgcagacaggcatgctaaggcatgaggaaagtccagttgatggggctggggatacccaggttcaggagggctaggtacaggcagtaagctatgatggatagatgtcagggaaaatcaaggtgtagaccaggaaatggtcccattccatcagatcatagcagatcaatgctgggtagcaagagccaggaaagaacagtctcctggccagcctgcattgggtgctgcttggtgtcattttacatttgtgtgggaggccaaggtaggaggattacttgagcctaggagtttgagaccagtcagggaaacaaagtgagacccagtcttaaaaaaaaaaatagctgggtgtggtgatgcactcctgcagtcccagctactcaggaggtttaggctggagcatcacttgagcctgggaggtagaggctgcaatgagccatgattgtgtctctgtactccagcctgtgtgacagagcaaaaccttgtcttaaacaaaccaaaagaaaaccgaaaccaaaacaaaacacaacaacaaaaaaagagaaaacaacataaaacagaatacacttatggttactaaccaacagcaggttctcaatgccccccacaagcctactatacctcctcttctggtcctcctttcattccactgggtgactatttcacagcttctcctgtctcattagattaataacacctcctccccctcactcacaccctcagtggatggcctcacatcccaggtcgctgagatggagaagcagtcagaagggaaggtcacctctaccagcatcactgcctgtctttctgctactggggatggccttctccttaatccctgctgagacatacacctctgttgtgcattatattccatctccctgttaggcactgaaggatgcagctccaagagctccctgctcttacccacagcattaaatcttcccttttgactggttcattcctatcagcatacacgcatattacacctcaaactgtgtctgattttaaatatggaaaaacaaactaacagaaagaaaactagcaaaaaatttatctccacgtgctgactccaatccctctccttctagttttcttttgcccctatgcccagtgaagattttatccatactgttccaccaaaaaaggtcttgaggttacagataaacttcacattgctaaagcccatgcttacttctcagcactcctcttacttgatgtatgagtaccatttgacacagctcatcactacctccttttgaaacacttctttcctttggcttccagaacactactctgttgatgcaccttttcctcataaactcctttgctggagtttgctgatggttcctcaccgtctctgtggctgctatctttgcagtgctttgggatctgatcttgcaccaattctcttctctatttacactcacttcttggaagttctcatccagattcttccaagttttaagcaccatcagtatatcagtgcatcacgtttatacctttagcttgaacctttagtataatgcctttagtatacttaagaatcttcagtatactgcctacttgatatttctatttggatgtctaatatgcttttcaaggtgatattcactatcacctcccactctcttgactggtacttctgaggtcctctccatctgaataattagcaactccattcttccagatgtactggacaaaaatcttagtcttccttgacagttttattgctctcattccccacagccaatccatatccaatccataactaagacatctgcaaatgctgtcacatccacagcagctatcttggtctgagtaatcctcacttcttgcttggattattacaatgccctcctaattggcgtacctgaatttctttttttacaatctaatatagtgcctttttgttttaacttgaaggacttcctgtaacatttcttgaggagcaggtctattggtaataaacttcccgagcttttatctatcaaggactgtcttaattttgccctcatttttaaaagacagttttgccagatatagaagtcttggctggcagttcttttcccttcagcactttgaatatatcatactgtgccttctggcctccaaggtttctaatgagaaactggtgaataatcatatagaggatcccttgtatctgatgaattgcttcccttttgatgctttaatgtatttcagtgcaggtctcttgtagttcatcctacgtgtagttcatcgaacttttgaatttgtagattcatgtatttcatccaacttgggaaaattttggccattttttcttcaaatatctctgcccttttctctttctcttctccttctggaactcccataatgtgtatgttattctagttgatggtatccccaggtccttcaaactctgtttacctttccttaatagtttttctttctggtcatcaaactcaaaactttcagttgtcctattttcaagttctgctgattgtttttgctgctcaaatttgtttttgaactgctcttgtgaatttttcatgtccattttgtacttttctgctccagaatttctttttggttccttttcatatttcctatctctaataatattcttattttgttcatacatctcattttgttcctgtttttgtccatgtgttcctttagtgctttaagcatctttaagatagttgttttatagtctttgtctagtaattctgccatctggcttcctcagggacattttctgttattttgttccttttaatgggatatactttcctcttttttaatgtgtgtgcattgtgactttttctttgtttaaaactctatttgaatcatataatttggtaactctggaaatttaatcctctcccctccccatggtttgttgttttctttccctccctccctccctccctctctcccttccttccttccttccttccttcctattcccccctgccccccaacctttcttttttatttgtacggtttctctttgccaaggatcagcctgcagtagaagcttatggtattcaggtcttttctgagtctatgtttttccctgagcatatgagatgactttctaaactccccggtataatgcggttgcttttgaatatctcatctttaagtgcctagttcctaaaatggggtagatgatttaaaaagaagaaaaacgtcccaggtattatatctttaaatcccctggaagccacttctgccactgagagctgcaacaatgcctacctctgtatgcacctctgcaatcagaagcagaaatcagcagccagaacacagaaacttagtatttggaggagggagttcttatttctcactctggatcctgcaagctgctgtaggaatgcaggctgctgtccccacagctgcctgccatggggctgggggatgaggaatgagtagtcactatagcactaatggctgaaataaatggaaattaattacaatttaccagccaagccttcctctggaacctgcaagcattcagatatacttcagagttccaaaatattaacttcagacagtttctgctagtacaatttttgtccaagtggggagatgagttcctggcactgcctactctgccatcttccattggatataccagtatttttaacatcattgtcaaagtaatccttggaagtgtgagatcattacttctcttctcaaaatccttccttggtttctcatctcacttaaagttaaagccaaagtatttaccaacggctacagaccctgtataatttggtgccctgctttctagccacactggtcttcttataatttctcaaatacttcaaatacttcccacaaacctttgcacttactctctctgccaggaacacacttctgtcaaatatctgaacaccatttcccctgactacttttagatttcttctcacgtcacttctcagtgaggttttccctgacctctaccactgccactcctactttacctcacttttctccatagcactttataggatctaacatgctgtagatttgctttttttattcatagtttgtctctgcaggataatgtgaccccatgaaggcaaggatttttttctgttgtgtttgttgctatgtgtgtctaatacacagtgagtatgcattaattatctgttgaacaaataaacaaatgagtaaagaaggaaggggaatgggtttttacagggaatggttttttaaggtagaggccatttaggttcaatatccaataatttaacttcatcagaatggaccatacacagaattctatgtggcttggatgacaaaggacgaaggccatattccataaaaggtatacaaaattattatgcttcctgatatagtctgatctctgtcctgggttccttgggcctgcctggaaaggtaaattctagcagttacaatgagacagcattcttcaggcatatatatctccacaacaattctgtactaaggcaggcagaggatcattcctttaataggtatttattaagtgcctgatatatataaggtattgagctgtttctggaaattcagagatgataaagaagttacacttctggtgcttgatgcaccagttgtttgtgcagtatgaaatgtatagagagtatatttatacagatagataagggggcatattggagggtacttacttcattcagcgtgttgatgtagtgggaaggcaggggttcaagaaaggtttctgagatgaactgagtgtggaaggaagggacagaaaatgtatggcaatgaaaggcagggtgtctgggttatgaggaggcattccaagtaagataaacaatatatgcaaaaatctagagccacatttaaaaaacttcaaataatcaaaactacagagtaagacatatggatcgaaatgaaattggaaaagtaagctgaagtcagatcacaatttttgaggcatgctagggcatgaagtcatttactaaatgctgtgaggatcatggaagtgtgttaaaagaagataaacatggcaaaaataataatgtccatttactgaacacttgttatgacattcagacactgtgtcaaacacataatgtatattctcttacttaaccctcaccaatgagcctataaagcaggtacttttccacattttatggccagggaagtagacagaggaattaagtacatggcttgcagattcacatagcaaagtggaagaggcaggatttgaactgaggtctgactgactcagtggtatgctgagaatgtatgcttaacaccactcctgtcatctggccactctaacagcagtgactagacagaacttaacagagctcagatatgacatacaggtaatctcagaggccatggcaattgaagtcattctcagggaagaagcctaatatgaactctgccaatgaggcttttggcatttcttagactcacttatcaaaggcgggccagggccagaagcatcagcatcagcttattagaaatgtagactctcagaccccaccccaggcctactgagtcaaccactgcagcaagatcccaggaaattcatgtgcaccttcaagcttgggaagccatggtttagatacacactgatatgtgccagagacaagtgataccagggagagggtatggtagctcgactggataacagggatacctggtctctgtccttaactggagttgtgggagtggaacgtatactacgggagatgctcagaaatggagagcccattttgtgctgtcttatatgtaagaaatgttatctttcctaaaagtgctccaaaagaaaccttttttggttcttttgattcttttgatgctgatgcttctggccctggcccacctttgataagtgagtctaaggaatgccaaaagcctcactggcagaaatactttcagtgtcaaaacagaactgatcaatgtgaattgtttatcagacatagattatagaattaaagataaagtcaagagaaatgctgcattagtccttagctatttaatggcagatcatatctgatcccaaactttttgaatttgtacttcaatttggagctggtaatgatacaattcatgcctattgctaccctgtaaacacaaatttccttactgatttaatagccatgtctgtgtgtagacagtgataattataaatggaggtttgtatcaaagctggacactactgtttctcttatctacacctcactctttctctttctccccatccctccctactcctctctccatttctctctcataggtggcctgcaacaaagtcagtatttatgaggcaaagtgtgcagtttcatgacctttttccttttgtgattggtgtggagacaacattgtggcgcacatgcttgaacctggtcctgtttccccagaggaccccttaccttgtttttgttgttcagagctgaggcaggaagccccgtaggaaacccgattaggtgaagcatcttcaagtccgattagaccacaggtagtcattagaaggatcaggtgccatctggggactttatgtgtgacaaagtcctgaaacatgttcaaaccccagtatgagtaagggaagcagtggaagcgtgctgggtatgcagaagcataaaatcatagcatttcatcgtgtgctgcttctgctgtttgtcctgcgttatgctgagtcaccaaattgtgtacgttcacagtcatttcagaattacatcaatgaggtaataagcaagagtgcctaaataaaacaaaaggcctagatctttatttttaaatgattaccaggagcaagtactgacttagaaacttatcagaatgagaaaatgtcaaacaatttcatttttagcctgcacaataacaactttctcctgttaacataaataaatgagggttaaaagttgtctgggagagaaatgcttgtgtactggtgaagtactttttctggaggataacactaggcaagaaagaagatgcaagggaaaccttcatgaggaagatttcacaactgcagagcatgctaggaactggtttgcttctggctgttgtctccttagggtgagctctgtctggtgattagcatcaccatggattaaattaattggctgtactcaatcccttgctggacatactgagaataaatccaaagacattagtttctttgcacgaaatgaggttacatatccagtgacatttatttgagctatttaaacaacttaaacatctttttcttttcttaataagggacgtttcaagttgtggtaagtacaaaactatttgaaatctttctttggaaaatattctgttttgctagttgtattttgttttccatgttatacttagattatatatctgtgttctgtctttaactgttagaaaaagcataaatgttattaataattatcttttacctaactatgccagcaaccttcacaatatgctgatattgaaatagaatggaacttcagtatcaggaaatcaagtgattctagtttattcaaatgagtaatgtttactttgtttctgacaataaaagcattatatacttcttatagacatctaggcaatacactaaagaagaagacagctgcttgtaattcaacaatgctgtgactaccacagtgaataactggtgattttcctttttgaatctcctctctcaactctgccccataggcttatgaaaatctgaaatgaactgatttttcttgcaacatcaagtctctgaattgctaaaagaatgaacattctgtacattctgtatttctcaattttccattttttctacttcattatttgtgacttgtctgaattcacactatgtggtagaaaattaaacttaaaatataattagtgaaatgacgcatgtactctgtcatgtttttgtcaagtgagtgagagagtgaagacacagccctcttggtagaggccaactatttagttctgagcagcacagctgtaaatgattgttttaagtggggtttgtttgaaactaatgatgccacagataagcctagccacagttgagcctaagggtgttaaaaaatctgcttaatattaaagagcaatgaaagtatgcatgatagctccattgtctaactttaggcaataaagagtctctgcagagaagaagagacgatattggtagcaagctgtcatgtcattagaagcggattttaaggcaaaaagtttttgtaaaccagcttccttgctacatataaggaagtcactggtgaagaaactggagggcctcaagattctacagttacctctttccacctccaccacttcttcagcctaaacttctgggagaattcaaccattttatgctgctcagtttgttcgttccctaggtagcccttaagtatattactgccttattccaaatttaaagggcataagatacaccttattatcgaaaatgtatgtaaagatacattgctaaatttccatgcaaattctgattcgttcttaaaactgattaagaatggagcacagctaacataggagaactcaaaaacgttatggagggctggtagctctgtttcacagaagtgggcactgtattgtcaagacttaatgaccacgttgctagtcttgctcaggtgcaccaggtaaatggtgtaccacctctgccttcttcctggagggcatctctaccactttttgcctctggcatctcaactttacacagactctcctctggaaattgccctctcttctcactcctacccccaatccctgaggctgtattagacatccctccttaatattctcttggtaccccaactcttcctcttcttcagttgagctattgagttactctgtgaacttcccatggactctgtaggaaatgcacattattaagacagggcaaaagctgattcacttccttcagaaatacttggtttgcaccctctttccaaatgatgacattgtgcaatcaatgaacacaaatgtttttattcaacaataatacctaatctttatcatgttctgggttttacacacaaggccctctttatcataggctcttaagactcacctacaaggatgcagaatctcaacactctacctaaaagttcccccagtgacttctaggagttcccagagattctctcacacatatgaagatcatgtgaacttgtatttttgttttgttttcactacagcatccccaacaaggtgcctggcaaccacgtgttggatgcaccttctctgcaaatgctcctccactgctggggacctggcatcttcccaggtcatggtaccttcagcacctgcccttcatgcactgggctcaaaaccaatgctcagggctgggtagcagtgggatagggacaatggcagctgcttctttgctcctattgtctttatcttctatgttttccctcctggccccagcacaaaatctttctctttagccaaaaccgacaaacaaaactacccacaaaattcttagcatattggctcacatagatgtgttcccaaagtggtcaccaggttaacagctctccaaatagtgagattcaggcatttaaaaagtgacattaagagcctcatgatgcacctacaccaagaaaaatatcattttccaaaattaagtgaaaaatgtgtctcaaatattattcatgtacgatattttcaaataaacatataagtacaccaacctaaaatataattggagacagagttctaaagtcttacttattttttattttatttttttcttgaaatggagtcttgctctgtcatccaggctggggtgcagtggtgcgatctcagctcactgcaacatctgcctcctgggttcaagcaattctcctgcctcagcctcccgagtagagtagctgggactacaagcacacgccaccatgcctggctaatttttgtatttttagtagagatgagatttcaccatgttggccaggctggtcttgaactcctaacctcgggtgatctacccgccttggcctcccaaagtgctgggattgcacgtgtgagccaccacgcccgggcctaaagtcttatttaaatactgaaggaactcatccttcttacagttgctgaggccatggcgattaagcagcttgctcaaggtcagaccacagttgaccagatgaggatgagaagaggttgcagttttgctgactccattgcgaagctggattccccagctcctgatgcacatgtctgctacagctgctatttttttggcttaagtattataattactttaaacctctgaggaagaaggaagggaagacatctaatttctaggctgatcttcaaatgtttttttttctaagttacatttaaataagatttgcaaatcagattggagatatatgaagaatcttggacaacagcttgcaaacatttaagtagataatttgggccaggtttatagctgatttacaatgataaacatgcctttttccatctctgtattaccaatcacattaattttgtttgttcaatttgtcttcaaggctgcaggactttcttactgtgtcaaaagacactaataattaaaatgatttcaaacaatagaaaacagccacaaatgaaaacaaggccagaaccagataaatccttccacatgctgctcatttgtcagtcaaactccagtttcactgagaagtggaaaaggaaaaccttagtgctttgctgaaaattactcttcttgaattctctcctgaaggtttaactttagaactactagtgggaccagtaaccagactgcaccagttttagcagcccatagcaatgctgtcattcattcaaaggacatttttgcttagtgcagtgtttcccaaagtaagataagtggtgtgtgagatgatttgcctgcattttctctaataagcggtggaaacatctgacagtatcttaagatggctcttacttaaggttctatgtgatacattcctcctagaacttaatgtcaagtacattttcctccagacaatttgaactttaaaaacatttcctgtttctcccatatttccttattgtcaggatatgaaggactaaattgatgaactgcaaaactctcttacttttctcagtggatggtttctgatttgtgtctctgttgttttttaaattgtgcaataatacctgctaattttaaaggttcacaaagtttagcaatgtataaaaaacacaaatattatccagaattctgcaatccagagataaccaccatcaacactgggttgtatatatttctggacttttccccaattcatataactcagtcatgtgccacataacactactttggtcaatggtggactacctatatgatggtggccccataagattataataccatattttgactataccttttctatgtttagatatgtttagataacaaattaccactgtattacaatgccctacggtattcaaacagtaacatgctgtacagatttatagcctaggaggaataggttattccataaagcctgggtgtgtagtaggctatatcatctgtttgtgtaagtacactctctgatgttcacacaatgatgaaatcacctaacaatgcatttctcagaacttatcctccttgttaagcaatgtgactgtacgtatacatttaaatcagtggcacagaatgttttgcaaactgatttttttcacttagtaatatgtcatgatcatctttctatgccaaaagatacatctataaggtcatgtttaatggttgcatagttttccattgcatgggtgtatatgtgataatttatctaggcccttattcgtgtgtttaggttgttttttcaaattatacatatccttatttaacagtttatctcttttattataagttccttaaaattgtcgttcaaaattgataggtataatgaatgaataaatgaatgaaagaataaacttctgtgaatatcctggatgtctgcagctatatttagcatgcattagtattaccatgtattcgctatggtgctgtgattctggagataattttctttcttctctaggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccgtagccgtcgctgctcccggcatgccccgccccccacggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggtgagcgttctgggggctcctcgagcctgagctcattttgagcaccctactaattggattcgtgtgggatatgaatggtggcccccgggaaggaaatcttccttcctccctgcctgtgtatgtgagtgtgtgtgctccgatgctgcctttgttcctttgtcagaatctgactggaatctcatctttccctcatgctacctacccctttctctcttccctgagccctgagttacataatgttttcacatggaatccaatcttgataatattttttggaaaggagtggcaaagagtagtattttcacagaggaagcattttcctgggatccctgctgggacgtaactgactcccccacccaaccttgacatttggtatttccgcttattttgtatacaccattggtgcctaagaaaatgctcagtgatgatgtctttcaagcctaggaggttgttgatttgattcaagcaaagttataaaattaccacttagtataaaatgtgctcatctcaggataatgactctggtctcttttaggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagagtaagtcacttattaatatatagcccatatttttagccctgagattttttttgcctcaaggacggcaaaatccatgcttcaatgaccagtttcttccaccacagaaacgaaaaggagaggatttaaaaacattctaaactgaaattggctatatttatagttggaaagagtcatagatattatctattttttagacttttccaaatcaatggtatgcctatttaaattgatgatgtgtgcttttttgcataaaatacctagttaaaaaaataaaaatgccagcatttcttgctttagagtggagtctgtgtaagtctcttctctggtagttgcggagttttctctaaatagtaccatgcagcatccatagctgacctcagcaggttagcagaatgactgtattttttcaaatctacgctatgtgctctgccttctgaagttattcctaaaaaaatcacaggttcttagatccacattttatttattaaataaaaggttcatgcaaccaattcatgctggttaatggtaatgtaggttgataattctgtaggatctgctgtgtagcattatcctttggataggggaggaagagggcctcttcaggcccagggatgtgggataagctgtaaattgcctatacagcatggctaatctcattattcattatactcagtatttccagggaagacaagctctttgctagagtactgattgttttttatacttaaatttaagtttttattctctttagacttggataatatgtattttaaatagtattaatctctctacttattgctaatgtgggtgaaactaatccattgttgtttaatgatttcatggatatattcaatagataattattaatgcttctattttgtaagcattaggttgccacatatatgttataaatatggtagtgctatttcacgtttgtcattttactaaaatgattttattatcttatgtctgatacagattgccgagtatggtttctgatgactgcagggaatctgagggctttgttaagttttcttcaaaaatttgagacactttgatttacaatttaagtaaaagcatatcaaaaataagaaaaaatatttctaggtttatactctgcaacattaaaggggcttacctgatggcaagtatgtgcaaatctatatagatttgctaacaggattttttttttttctttttgagatggggtctcactatgttacccaggctgttatgatgggctcaagtgatcacccgcctcagcctcccaaagtgctgggattacagatgtgagccattgcgtccagcccaggcattttgactgaatttaagaagcaagagtgccaaggttaatgctgaagatacatgttaaaaagataactgatatctggacttatgtctagctctgttctctcttgtgccctatattaagtcagctgcaacgattatacaaagtgcatgctaaataattagtacttgattaattcagtctgaatcataaaatgtttctgctttcataaagctatggatacctgttttgatatgtgtaggtgggaagatgaataccatcataaattgttggctgccttgtttgaataggtaagcggtatttggttagactccagtttcagtactggtaaacaaaacaacgaaatgaaaacccacaaaaaacttttatctttggtagaattcttagcactttttactttatacatttttaaaattaaaattaccttattaaacttgttaaaattctctgaacctccacattgaaattgaggtagaattagagatctcttctaaagagtggtttgaagaaatgtaccactgttatagtaggttttctcaaataactattgggaaaacacataggctgagcgtggtggctcaagcctgtaatcccagcactttgggaggccgaggcgggcggatcatgaggtcaggagatcgacgagaccatcctggccaacatggtgaaaacctgtctcgattaaaaatacaaaacaattagctgggcatggtggtgcgggcctgtagtcccagctattcgggatgctgaagcaggagaattgcttgaaccctggaggtggaggtagcagtgagcccagatcacgccactgcattccagcctggtgacagagcgagactctgtctcaaaaaaaaaaaaaaaaaaaaaaaagaaaaaaaacaaaatacatagagctcagaaacatatcagtaacattttactatgaaatacagaaaatatgctacttttcatactaatcatttccccttttctctttctttttttgctgcctcttcctttggatatttctaacttctctgccttccatattatattttgatgtgggcaccttttactcttaaaatctttaaagtaagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaagaggaagaaaccataaaatggacaactactgtcagtaaaactggtccttctaataatgatgaaaagagtgagatgagttttccaggaagaacagaaagtcgatcatctggtttaaagcttgcagcatgttcattctctgcagatgtgtcacctatggagcgaagcagtaatcaagagggcagtttggcagaggagataaacattcaaatgacagatcaagtggctgaaacttgcagttctgctagttgggagaatgctactgtggacacagatatcatccagggaactcaagaccaagcaaagcatcgtttttataggccccctacacctggactaagaagagtgagacaaaagaaatctgtgattggcagtgtgaccttagtatctgaaactgaggttcaagagaaaatgattggacagttttcatatagtgaagaaagggaaagtggggaaaacaagtctgagtatcacatgtttacacattcttgcagtaaaatgtcatcagtatctaacaaaccagtacttgttcagatcaataacaatgatcaaatggaggagtcatcattagaaagaaaaaaggaaaacagtctgcttaagtcaagtgcaataagtgctggtgttatagaaattacaagtcagaagatgttagagatgtcacataataatggtttgccatcaactatatcaaataactcaattgtggaggaagatgtagttgattgtgtggtattggacaacaaaactggtatcaagaacttcaaaacttatggtaacaccaatgataggttcagtcctatttcagcagatgcaacccatttttcaagtaataactctggaactgacaaaaatatttctgaggctccagcttcagaagcatcctctactgtcactgcaagaattgacagactaattaatgaatttgctcagtgtggtttaacaaaacttccaaaaaatgaaaagaagattttgtcatctgttgccagcaaaaagaagaaaaaatctcgacagcaagcaataaattccaggtatcaagatggacagcttgcaaccaaaggaattcttaataagaatgagagaataaacacaaaaggtagaattacaaaggaaatgatagtgcaagattcagatagtccccttaaaggagggatactttgtgaggaagacctccagaaaagtgatactgtaattgaatcaaatactttttgttccaaaagtaatctcaattccacgatttccaagaatttccatagaaataaattaaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacgtaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgacaggagataatctatgtaaagagggagataagtcttttattgccaatgacactggtgaagaagatctccatgagacacaggttggatctctgaatgatgcttatttggttcccctgcatgaacactgtactttgtcacagtcagctattaatgatcataatactaaaagtcatatagctgctgaaaaatcaggaccagagaaaaaacttgtttaccaggaaataaacctagctagaaaaaggcaaagtgtagaggctgccattcaagtagatcctatagaagaggaaactccaaaagacctcttaccagtcctgatgcttcaccaattgcaagcttcagttcctggtattcacaagactcagaatggagttgttcaaatgccaggttcacttgcaggtgttccctttcattctgcaatatgtaattcatccactaatctccttctagcttggctcttggtgctaaacctaaagggaagtatgaatagcttctgtcaagttgatgctcacaaggctaccaacaaatcttcagaaacacttgcattgttggagattctaaagcacatagctatcacagaggaagctgatgacttgaaagctgctgttgccaatttagtggagtcaactacaagccactttggactcagtgagaaagaacaagacatggttccaatagatctttctgcaaattgttccacggtcaacattcagagtgttcctaagtgcagtgaaaatgaaagaacacaaggaatctcctctttggatggaggttgctctgccagtgaggcatgtgcccctgaagtctgtgttttggaagtgacttgctctccatgtgagatgtgcactgtaaataaggcttattctccaaaagagacatgtaaccccagtgacactttttttcctagtgatggttatggtgtggatcagacttctatgaataaggcttgtttcctaggagaggtctgttcacttactgatactgtgttttctgataaggcttgtgctcaaaaggagaaccatacctatgagggagcttgcccaattgatgagacctacgttcctgtcaatgtctgcaataccattgactttttaaactccaaagaaaacacatatactgataacttggattcaactgaagagttagaaagaggtgatgacattcagaaagatctaaatattttgacagaccctgaatataaaaatggatttaatacattggtgtcacatcaaaatgtcagtaatttaagctcctgtggcctttgcctaagtgaaaaagaagcagaacttgataagaaacatagttctctagatgattttgaaaattgttcactaaggaagtttcaggatgaaaatgcatatacttcctttgatatggaagaaccacggacttctgaagaaccaggctcaataaccaacagcatgacatcaagtgaaagaaacatttcagaattggaatcttttgaagaattagaaaaccatgacactgatatctttaatacagtggtaaatggaggagagcaagccactgaagaattaatccaagaagaggtagaggctagtaaaactttagaattgatagacatctctagtaagaatattatggaagaaaaaagaatgaacggtataatttatgaaataatcagtaagaggctggcaacaccaccatctttagatttttgctatgattctaagcaaaatagtgaaaaggagaccaatgaaggagaaactaagatggtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctggatgttcgcaatgaaacctgtgccaaggaaagaatagcaaatcatcatacagaggagaagggtagtcatcagtcagaaagagtatgcacatctgtcactcattcctttatttctgctggtaacaaagtctaccctgtctctgatgatgctattaaaaaccaaccattgcctggcagtaatatgattcatggtacacttcaggaagctgactctttggataaactgtatgctctttgtggtcaacattgcccaatactaactgttattatccaacccatgaatgaggaagaccgaggatttgcatatcgcaaagaatctgatattgaaaatttcttgggtttttatttatggatgaaaatacacccatatttacttcagacagacaaaaatgtgttcagggaagagaacaataaagcaagtatgagacaaaatcttattgataatgccattggtgatatatttgatcagttttatttcagtaacacatttgacttgatgggtaaaagaagaaaacaaaaaagaattaacttcttggggttagaggaagaaggtaatttaaagaaatttcaaccagatttgaaggaaaggttttgtatgaatttcttgcacacatcattgttagttgtgggtaatgtggattcaaatacacaagacctcagcggtcagacaaatgaaatctttaaagcagtcgatgagaataacaacttattaaataacagattccagggctcaagaacaaatctcaaccaagtagtaagagaaaatatcaactgtcattacttctttgaaatgcttggtcaagcttgcctcttagatatttgccaagttgagacctccttaaatattagcaacagaaatattttagaactttgtatgtttgagggtgaaaatcttttcatttgggaagaggaagacatattaaatttaactgatcttgaaagcagtagagaacaagaagatttataatttcaatatcagcacactcattctttgtcaattcattttttcccatgagatgaagcacatgtgacgaatacggactagataacctctaagaattttccacttcttcaaaatgaacttactctagaaagcttacccttggataaccagtttgactttcataatgtctctgttttttgtttttccaacaattacagactcaggttctcttattttggaagtttctatctggttttgttctgaacttacattttttttttttttggtatctatgattttttttgctcagggcatcaaaatgtgctaaggacaagaattatatcctttttaaaaaatgttgttagcttggtgtaaaatgtatattgactgtattggtgaataaattgaatagacataacctcaaagtacttcacttattctttttaactactgatttgataaaaagtatgattataagatatccacgacaatctcatagtttcttgtgccaaatatgttgagtccagttcctcagaatatccagtgaaattgcaagcatttccatgggacaggatttagtgtttttctaatagactagactatcaagtatcaattggtttgaataattgtggtgtatttcccaggagttaaccaggaaagcttttaagagtccttccactgcatgactatatgatgatatagaaacaagtcttaggaaacttggaaatctatgcctcttgtctacaactaactcaaattagaatgatcagtatttttggagccacacatggagatgctaaaataacataaatttggcattgaggaacaaaaggtaattaaattaattacatcaagaataatgttggtgtcagttcagcatgagtcataaattcataaaaattatgaattgctacttcatcagctggagactacttctatgtagagtatgctttttaaaaaaacattaagtgatgctttcttttagtgaaaatatggaagctataatgttatgtaagtttctgtagtaagcaatgagaaattgtagtgaatgaaagggcacaaagttttggagaaaaaatagaaaggagaaaataatttacattaattttgtgcctactgtgtaccagggactgtggtacacctgcaggctttttgtgtgtaattcttcctcataaaagcactgtgaatgtggctttattacttcccctgcattttttttttttttaagtagagaagttaggagcaaaaggtaaaggactttcatgactggtttacagtagggtatcatgccaggatttgaacccagttctttgtgcttgaaaatcaatgctctttttactacttttttttttttaaagctgattctcagtatgtttcacaggctggttttgaactcctgggctcaaatgatcctccatcctcagcttctcaagtaggtgggactgcaggcacacgccactgcgctgggcatcctacatttttatcattgttttcatgtgaggaagaagggataagatttttttttttttgagacagagtttcgctcttgttgcccaggctggagtgcaatggtgcgatctcggctcaccgcaacccctgcctcctgggttcaggtgattctcctgcctcagcctcccaagtagctgggattacaggcatgcaccaccacacctggctaatttttgtatttttagtagagacggggtttctccatgttggttaggctgttcttgaacttccgacctcaggtgatccgcccgcctcggcctcccaaagtgctgggattacaggtgtgagccaccgcgcccagccagggataagatatttaaaaaaaaattaccactcattctctagtgcagggagacaaggaaagaatttttctttttaatttggaaggtgtgaaatatagatatacccaagaagattgaggaaatcatttataaaaaccaggaggtttcaagaaatatggcatgcagtatgtagtttttggcaatactattacaccaaacagtgtccttcatgcatcataattgggagaagctggagtgacaaccatgaattagtaatgcatgggactgtgtaacatacttcttctttaaacatacttctttaaagtgaacgtgttcacatgcattgaattctgagatcttgggccacatcttattcacagagctagcttcgtacttggtacatggtaagtacctaataaatgtgtgttaaatggataagaagtgcatttgaaggcatttaatttttctttacctcttactaatttcagatccatacatgtagaaggatgtgcaaatatgctgaaggatagaactcagttttttgtattttttttagtttttttatattttacgaaagcagtattttagttatccttaaaatgtctgtaaagatgattttttcttttaagcattcaaagcatgtttttagttttgcaagatttatatttaaaaaatcttgtcacactgtgaaatttagaagagtaagtgaaactttagaggaaatttaaggatattatagagagctagcttttgctttagagatgaagtacctgaagggctgagtatggaagtgtagcctcccttactcaggggaagatatgtagaattcagtctctggtcccaaggtggagtggtgaaattattgtgttttgcccaccagatggcagctgtgctatgcgctgccaaaagttcaggcactctgagaggcttgcatggataaaggcaatgctttaagcattggggcagtctctgagcttcctgcttctgcttcaaagaaagctgaatgcccaactgtgcaggcatcccccaaatattaaacccggaagaagcagcagtgttcagaattaaaataaatatactattagtatatttagtagcaaggagcagaagttcaaaagtagaggcactcaaaaatgccagctgtcaagaatcatcagagttgattccaaggaaagcccaatttggggactatgggacccaacaaaattccctaattcaagctgaaactaagttaatgagctattggttcagtggataggggtaatttttacatgacactttcaaatattataatgtaacttttcagtggcacaaaacatgcctcatttttcagagtgtaaactgaggtattgaaactacattccatatttgtggcactcattaaagttcttatgaagagctaccttataaggtggttgtgagaggatcactagagaaaatacttgtaaaactcttagcacagagtttggcacacagtgttaaacatgttttagctatttttctttaaaaagccattagtgtgaatacgtttgatacacttttcaaagttggtgttcttctgaccaagatgtattttagctttattttgtgcctctctctctctctctctctctctctctatatatatatatatatatatatgaaatgtaatattttcaacatttagtcatatagcccttcacaaaagtgaaggtgacaaacagtttgagcccctgctctgtgccaaatattgggctaagttctttatgtgtattatcttagtcctcacgagaaccctctcgatgggtaacagtacctttaatgtagcaggaaggggactaaaactcacagaggctagtaaagaagcacttttactttaatatctgtattcgattctcataaaaagtcctgagttttgtggtttgatactctatgtacagatctaccctgaaaacaaaatgactttctattccctgtttattgaggttaagaaggattccattactgcccagggttcttttaatccaaagtacttaccatttttcctactattctacgctcttgtccattaaggtattaaaggataattgtttttaaaagcaaaatcatgaattccatatagatataacatgaccatgtgccaaagattgtatttaacttacaaattacatagggaattattaacatatacaatgggctgaaggaagaatttaaagtatcactaaaaataagcaataagaaatgctgaaatgaatttgggtctgtccaggacaaaaattacattccctggacaccaccaatttatatttctatggacaagaatagtttgcattatctgtgtttttacaatttgcaggattatcagataatttaaagataatgaaaaaacagagataaccccaagagggcttgataaggcacttagtaatttcttttttgtccatttcaaggtatttcacagtttttttcctaaaagggtttatcttccagtaacttaagtgctaagttattaagggactattcccaagtcatggcaaagaatgtatgaccaaaaagcttttgaaaattaagcaacaaaacagcaaaccttcaaacagagacaagtactatgtttgatggtttagagaagatacgttcatcttgttctagacaaaaattagtaaacaattcccatcatggactttagatgtaatatacaatgggctgggcgcagtggctcacacctgtaatcccagcactttgggaggccaaggtgggcggatcacgaggtcaagagatcgagaccatcctggcgaacacgttgaaactccatctctactaaaaatacaaaaaaattagccaggtttggtggtgggcacctgtagtcccagctactcgggaggctgaggcaggagaatggcatgaacccaggaggcggagcttgcagtgagccgagatggtgccactgcactccagcctgggcaacagagcgagactccatctcaaaaaaaaaaaaaaagatgtaatatacaatgattatttttttatcaatgggaattctttctaaaggatatacacatgagccttttctctatgcatagatatttcatatattaatgtttactttttgattcatacacagattatcataacaatcagtaacagcaagaacaaaaaacaaaggtcaatggagtagaaatcatttagctgcttttcatcttgagaatagttcttttcttctgtaacactaatgttgataaatggctgcagtctacagactactacttacgtaagactgcttaaagctcaggtgaatcaatacaaccaagtaaattaagataggatggtaggttcatgggaaaacatgacttgtacatcacaggaattcattatattgagagtgaaagtggttagtgagaaatgggtgatacaaagctaaacactatatttatgttcatatatatgaatattcatatatatatttataagtttatttaatgtagttgctgcctcagcatccatttttaggattgacataatatttgaaatttagtcctactttgtcacctttggcttagttaaaagcttactttcccgtgtagttgtttgccgtatggcttatttgttcctcacttctttgacccaaaacccaacacaccccacagctattgaacgtgataaaatgtaacggtcaacaccagagtcacataaataggttcaccccttcaggagggaagaggggaacttatttctttaaattagcccatctacaacccccacaagaaagcctaagggataatgtccacagagcttaataaaggcatacacagtcccagagatttccccgtccctctctcccaaaagttctgtctcacaacctccctccttccctttctccctcttcctctcctccccactgaccccttgctgattgagctccctgctgcctctttctgttggcacccctaacctttctgggaactgtgaataataaacacttatgttttgcgcatttccatttcacttcattgtgtctcatttggcatagatgctcttaacgtagccttctttttggtcagagctatcttagagagtggctgtcttgacaggaataatctggatacaggtcaggcaagacccacaagggtgtctgcctgaaaaaacagtttgttgtgagagggacacctagtcatgggtcagacacttaggcaataggcatccttcaggataaagaggcatcccatggaaggcgcactgtcaacatccacaacaaaatcctttgaatttctggcaagggcaaggctggagcttatggccactctcaagaaaaacctcaagaccaaattagaaagaaaccatcataaaaatcacaacagttggctgtgcatggtggctcacgcctgtaatcccagcactttgggaggccaaggcaggtggatcacctgaggtcaggagttcaagaccagcctggccaacatggtgaaacccgttctttactaaaaatataaaaattagctgggcctggtcgtgggcgcctgtaatcctagctactcgggaggctgaggcaggagagtctcttgaacccggtaggtggaggtagcagtgagctgagattacgccactgtaccccagcctgggcggcaagagcaaaactccctctcaaaaaacaaaaacaaaaaacacacttgcatacatatgtatcccatttattctcatggatgtggtatagagaatccaaaagaataatttcatgtcatttaaatgacattggagtttgttttagacatatatttcaatataggtctgttagtggaaattctcagtcaaaaagacattatatgaagaataactaggaccaagagaaagttctctagatttgttattttatgcctttgcttactttctccctgttcacctattagtttgcaccagtctgcacaatgggctctgtcctgtcacccttccaggaggcatggtgtagcatagcattatggagattgtctggtgctcttccttcagcaggttgatgttgaggttagccttgtatgccctgttcggtatcctgctaggaacttgtggacctcatctggatcaacagatagagtctcatgaaatatctggttgtcatgaaatgtcaaagtatgtagagtgctatgtaatagctcgataggactgattgaactcctgggtggtcctgagtgggttaggaaaggggtccacagtgagtgcctagctggacaagtctctgcatacagctgaccacctaggcattaagagccagaaccacacagtagacctgcactggcaggctatccagcatagaagttttactttttcaatggtgaactcttccatttgcatttttatttcttatcaaagttatacatttataactagttttaatcagaagtgcatagctcaaaataaaaaatagaccactttctgaccctgtacatgcctaattcccactccagaggcatctttcttgaaaatatttagctgtttttctgctgtttatttctgtatttagagacatactgctttttttttcaattttagattttgtgtattgacatttcaccttcagcctcccacttcatatctctgccaatataattttttttattaaattacagggctttcattaataaccatgtaaatatgtaaatattttcctcagctgagccttttagtgtatcctgactacattttcttttttgaactattttttgttttccttggattaaaaatggactaccatttattactgaactcttccccagggctgactctgtcagcataaaagtgcacatctattctatttttttcccttggggacattatttttcttgaaggcattccttggggaagtcccttcccaactcctctacccagctccctcctcatccgacgtgaactgcttcaatccaggtcagctgtgcagttgtcatcctgagctatccctcagcaacatcctgggaatctccttttcctctctatattgaatgtcttgtttattgaaatcttagtttaggcctcagtttaggtggagaaaattctcttatagtttataataaggggtgcatgggagttcttttttgattcttgaatgtatgaaaatatcttttggcaggtggattgcctgagcttgtgagttcgagacgagcctcggcaacacagtgaaaccctgtctctactaaaatacaaaagattagccaggcatggtgttgtgcacctgtaatctcagctacttgggaggctgagacaggagaatcacttgaacccaggaggtggaggttgcagtgagccgagatcgcgccactgcactccagcctgggcgacagagtgagactccatctcaaaaaaaaaaaaaaaacataccgttattctcatgtttaatggataaaaattatatggccttatacattagaagtaactcaaacattttaaaagctttaaaaatttgtcttttattttctaatcccaacatgaaaagtactaagccattctcatttctgctcccatacatgtgacccctctccccttcccaaaagcttttaggaccatctgtttattctggtattctgaaatttcacaataatacacacttgtatagggttggtttgtttgtttttgctacactaggcattcagtacccgtatcctttagttctgggaatttgttttatattatttctctgatctttcccctccgttttttgttctttcattttaaaatttctattatgaatattacctgagcttgatgaacctctggaataattccttaatttttaattttcttctctctctctctctctctctctctctcggtctctctcaccctttatttgggtataatttacatttgataaaatctccccaattttaagtgttatgatttgatgggttttgacaaatatatgtattcacataatcaccactatagtaagataatggaacatttccatcactcaaaaaaggactttttatttccctttatagccagtcccttctcccctttgcccaacccttggaaaccatggattcactttctgtggctgtagtgttttctctagaattttatgcaaatggaatcttatggtctggcatctttgatatctgcttcttttacttagcaaaatgattttgagattcattattgttgcctgaatcagtagttgtttttcattgctgagtggtatttcattgtatgtacataccacactttgtttatacatttaccagctaatagacatttatttctggcttttggttattatggatataagttatataaacattcatgtccagtcttcttgcaggacatacttttttatctttcctaggtaaatatctaggagtgagattgctagcttttatggtaattgtatgttaatgagaaattgccaactcctttcaaaagtagttgtatcattttgtatccctaccaacaatatatgaggattctagttgttctgtattctggtttgcacttgctattattagacttaaattttagctataccagtgtgtttactttctgcatttaatttgcatttttctaatgactattgatgttggacatctttacatgtactgatttgctgttcatatatcttttgtggtatagtgtgttttcaaatttattttctgttgggcatttgaaatctagagctgcaagagttctttacatattctgggtacaatatattcacttgatcttagccaaaaggctgagaagcaattatatatataatacaatatacaatatattcagatgtatgtcttgcacgcattttctcctagtgtaatagcttgacttttcactttcttagtggtgggattttgaatgaacaagttttaaattttggtaagcccagtttgttaatttcctttgtatggctcatgcttttcaagtcttatctaagaaatctctgcctgcctatctcaatgacaagattttctcctgtgttttcttttaggagtttcatcattttaattcttactttgggtctatttgtcccattttgagctttttttttttttaaatatactgtgggaggtaagagttgaggttcattttattttaaatggacatccaattattccagcactctttgttccaaagactatcctttcttcattgaatactttgatttagaaaggatagtcttttgtcaaaagttaattaaccacatgtgtaggggtgcatttctgcattctctattctatttcattgatttgtgcatatatttgtatgccaaaatataccatcttgattactgtagctttatagtaagccttgaaaccagatagtgtaaatttttccaactttgttctctttcaaaattgctttgaccaatctaggttctttcatttttcctttttaaactgctaaaccagcagctggagagtaaagctttgaatgcctagcttggaacttccccctgctgtgtaaatttttatctatgccagaaaagtagccttgggccttatattcctgggtgaaaagagagaccatagaagatggagtcaagtcggctggtgcttagattcaacatgcagaagagtcctagagagaactacacacaatgaccctgcccatctgtaaagcagtccatcattaccttggacactcaaattggtattttgctactttaggtttttctggcctgaaaagagaaacagttaccttccattagttctgtatcttatactacttagaagttacttattttatggctacttctgatttcacacaatctttttcaaacaacggtggctaagattgaacactcttattgccttgcttggagtttgatttccatggtttaatcccaagtatttgtgatttatatttgcccaccaatataaatctccttttttttttttttttttgagacagagtcttgccgtgttgcccaggctggagtgtagtcactgctagctcctcctcccgggttcacaccattctccttcctcagcctcctgagtagctgggactacaggcacccgccaccacgcctggctaattttttgtactttttagtagagacggggtttcactgtgttagtcaggatggtctcgatctcctgaccttgtgatctgccctcctcagcctcctgaagtgctgggattacaggcgtgagccactgcgtccggccataattctccttatagacaccattgtaatccagtggctacatacctatatcatgaaggctgatccttttctgtttctttttattgttatgtatatgaattgcaatcactcaggcatgtagacagacacaggcactatttctctaattttgtatattaggagattaatttccatttatataataaatttgtcctctgaaatttccaaggttgataacagtttttacatgtaattcttaagtagcttaattaattagcttctcaacttttttttctgttattgcctcctgctaatgagagaaattaaatactaaggaataatgttttgccagatagcactgagtttagagggccccaaaccattgtatatttaagcttttttgccctccaaaaaccagtttttgtcctttgggattaatattgctctcatgagaatgcgtggtctaattgatgcaaaagaggtaattttgtaacaattataatgaaaataactttcctttcttgggtagctgttatgtaataggcaccgtactatgtgcttaacacatgttgtctgatttagctctcctaaaggccatgtgaggaatgtattatttctgttttctgagtgaagacgctgagaaagtttaacttatctaaaatcaagtttcagactagatctcaaaatgattatgtgtgacgctgaagatctactaccctcctctcctcacaaagatactattcacattcatagaaaagtcaagccatttctgactagagatgcacaattagttgtggtactaaatttagtgtactgatttgcagaaatggttcagtcttttctgtttggcatcacttatagatcattaaagatttttctagcctgtgaatactctactgggaagaacagtttacatatgattattaggaactctaaatataaaatgataattctaaagaggacttttataatcacaaggtgaaaacatttttttttgttttgaaagaatttaggcacaaagttcctatatgctgatactcctaaagaactttgcattggttaactatatatatttttctctttacatacttaaccaatttaaaaaaggtaaaagttatatagcatgtagtaaaaaaattagatagtgtaggcaggtattaaataaacaatgtcttccttctcccatctccaacttctaaactttatttataaaggtatcttaaggcgttttttctaaactttaaatgtgcatagcagcatgtgtacatatatttggggatatcttttttatttgtaaaactgagataatagtatccaaattttaccacattttgctttattcttttaaaatagttgtgtgttgcactgagtcaaaatttaactcattctgtatttaaagatacatgattgtatctaaatatttgctacttagataaggagacttttgaagaatgttcttagtacacatagtttggcgtcgttctgagtatatttgtatagtaaattacaggagtaaaatagttacattaaagaatatgtgcattgtaaaatttcatagatattctcaagctgccattcaataaaggtatgtgaaacttcactgatgtcaaactgtgtttgagaaagcccatttcttcggactgttataacactaggtgttttaaaactaaagatttttgtcactctgatagatgaaaaacaatgttttgatttgcctttcttcagttataagggaggttgagcatattttctatttcttgatcacttgtgttctctttttttttaataaattgcctattcatattcctgtccatttttccattgtgatatcgatgttttgtttagttttgttttattgattgtatgaattatttgcaaataaaggaaatttgtcctttttcatttgtgtggcagtttaaaacaattttaccatttgggttataacttttacaagttttgtttattaatgttgaaaaaaatcaacttattgaggtataatttacataaagagatgtatgcattttaaatgtacaatgtgatgagttttaacagttgtgttcacctgtataattaccatctcaatcaagatacagaacaattctatcccaaatagtttcttcatgttctctgaagataattccaccattcctggccctaggaaagaactcatttgcttttagttatacaaataagcttgcctttttctagcagttcttctgtggaatcataaagtatatactcctctgactagggttttgatcatcatgaagcttaagattcatccaagctgttacatctattagtagcttgtgccttttaattgctgagttgtattcattatgtaacacattttacctgtagagtcacctcttgtttgctggggcttctgtaacagattaccacaaactgagtaacttaaaagaacagatttattctcacagttctgaaggctagaagtctgaatgctgtctctaaagactctaggggaagatcctccctcacctcttctctggcttttggtggttgcctgaagtccttggcattctttggcttgcagcagggtagctggaatgcctgactccatctttgtgtagcactcttcctctgtctctgtatctcttctcttcctataaggacactagtcacccataacagtttgctttctagcccccaataattcacatccttaagtgcaaaatgcatttaccgcatcccaatattcccaaaagttttaaccattccaccatcaacttcaaattcaaaatctcatctaaatattataatttcacaaagtcccaaatctcattttatatattatcaaaataaaatttgggtgagactctgggtataatgcatctcggaccaaaattcctctccattcacagatgtgtgaaactagaaaacaaattatttgtttctaaaatgcaatgatgggacaggcataggataagtattcccattccaaaaggaagaaactgaaaggaaaaaaggggtcatgtgttccaagcaagttagaaacctagcaaatttcattagatttcaaggcctgagagtaatcctcagtggcttactgctttgttctctgggccctacttgggtggtagcctacccactcagcccccaagggcagtggctttaccctctctggccctcagagtcatttgtcccatctctgtttctttcatctgatgaaataatattctccaaaaaccttgttggtcttctgtggatgccaaaggggtccataccattagacacaaggacacaagggttcttctccacagatctttccttggtaactccgtctctatttatggcttctgctgagatggctgattggatcagtgaatcatatgtttaatgctgttagcaagaggttgttcaggcacacccctggcctatttccagagcctatctagaaagctttaggtatttgttacagcagcaccccacttcttattaccaaatctttttcagtttcctgggactgctataagaaaagtaccataaattggtgccttcaaacaacagaatttattcattcatagttctgttggctagaaatctgaaatcagagtcagcagaattggttcctttgagtgctctgagggacatcctgttctgtgtgtccctcctagcttctggtgatttccagcagtccttggtgttccatgatttgtagatgtatcatgctaatctctgcctccatcttcacatgacattttccctgggtgtctcttttctaagttgtattgggttaagagcctacactattccagcatgacttaatattaatttatatcataattacatctgcaatgaccctatgtttaattagggtcacatttataggtaccagaggttaggatttcaacatatcttttttgaagacagaatttaacccatgacgaacctgttgatggacatttgggttactccagtttctggctattgtgagtaaaactacaatgaaaattcatgtacaagtttttgtatgtttttatttctttgggtagtttactacaatggaatttcggggatatatggtaagtttgttgaactttacaagaaactgccaaactgtttccaaagtattatgccatttcacatttcctctggttatgcatgagagttctagttgttctatgtccttaccttggtattttcactgtttttaattttagttattatatgtagtgctctatctcattgtggttttagcttatttacatttctctaatgaggaatgatcctgagtatcatttcattttctcctgtgttctgttaatatggtgaattacattgattggctgcttaatgttaaaaaacttgcatttctggaataaacttgaagattatagttgatgtggttttctaatattttgttgagaatattttcattgatgtttttgggggttattgctctgcagttttcttataatgtgttttctgatttgggtaccagagtaatatgcttctcatacaatgagttgggaactattccaaatggtttatataggattgataccattttttagaatagtttgatacaaaattcaccactgaagccatctgggcctgaagttctttgtgaaaaatatttacagtataaatttattgttttttttagaggatataggattattcaaattttctatttgttttgtgtctgctctggtaaattgagtctttccccaatctgtttgctcattaaatgactaaattgtttatataaagaaaaaaggagctgtttgtccaccacccgcattctttttttctccagttcatctactcaccccttcaactcactctttttcaaatcgaggcctagtggtatatgtatattacaaagacttagaattttgtctattcacattttttctcccatagcatttctgagaaaactgggttagatgctggacaaactcctgaaatcttctgtcttacttgctttttgacttctactttaaaagattatggcataaagttttgtactttctttctgctgatgtttctttttcttttttttggcttcttattgttctcttcctcctccctactctctccttctcctccccctccccctcttttctgtctccttctaatttttcttattcattatgttagtttttctgtgatctgacctcgcctcactaaaatattacattaagaatattctgatgtttttctcttttggtgtgttggcctattacctcatatagattacaagctaatggaagacaatgacatcatcttatgtttttcatctactcctccctagacagtggtcaactagtaatgacccaatgacttgttggctttctgtcgattgaaatgtaagttataaactgaaagatgaatcttcgttcatgatctttagattctactccagtttttatggtactctgttgcagggttaaggtttgaatcatttaatgatttagggaggtgcaaaaacctatagtaaacggacatcatatttcattattttcatttttatttccattctttcacttttcagcctttccatcctagttgttggaaaatgcaatttctttcttgattgatttgttccgtgcatttttagcaagtattgattctcccctgaactcttttgctgcatttctaagacagaagtatggtatttcaatttattcaaacaagaactaacataccagtcatcctacagagcatagctagaatttttctagctctgtagtttgtaattgcaatttaacattttctgtcactgttaaagacagaccatccttgactagtttttttaaaattatgtttttatttactgattgtctaccaagatgatttggtagcctaacatggctttccactatgtgtagggcaaacaaaatatagttttatatttttaagtagattttttacaaacaggccaggtgcagtggctcatgcctgtaatcgtagcgtagcactttgaggggccaaggtgggtggatcatttgaagtcaggagtttgagaccagcctgaccaacatggtgaaacctcatctctacgaaaatacaaaaattacctgggtgtggtggcgggcacctgtaatctcagctattgagaggctgaggcaggagaatcacttgaacccaggatacagaggttgccatgagccaaggtcataccactgcactccagcttgggtgacaccagcgagactccctctcaaaaaaataaaaataaaaaatacaaatacaaacatacattaatttaatgtgtatttattgtaccatataaatttaaatctagcctttggttatttattttaatgataaaaatggcaaatacattttagttcaaagttggaagagaggaaaacagtctaatgagtagaatgccatttaagtcagtagttcttaattttattaccttatattcttacttattttatgtaatcttgagtgtgttccctaatttctcattacttcacttttgttttattccttttttttttattttgagataggttcttgctctattgcccaggctagagtgtactgtggcaagatcacagcttgctgtgacctcaaattcttgggctcaagctattcttccacctcagccttccaagtaggtaggactacaggcatgcgccaccacatctggctttcatttttcttatagatcagctttctgattgacatggtttggctctgtgtccttacccaaatctcatcttgaattgcaattcccaggtgttgagggaggatcaggtgggaggtggttggatcatggggatggtttcccccatgctattctcatgatagtgagttctcatgagagctgatggtttcaaaagtgtttggcagttcccccttcgcgtgtgctctctctctctcctgccttgtgaagaaggtacttgcttctcctttgccttctgccatgattgttaagtttcctgaggccttctcagccatgtggaactgtgagtcaattaaacctcttttatttatgaattacctagtcgcaggtagtagctttatagcaatgtgaaaatgcaataatacactgatgtttaccccaaagaaacctgacaaaattaaatcgaaatcctaggacattatatcataccactattaatgtactataatgtttagtcagtctcagttatgttcacagtgagccatatgttttctagcattgttttcatttgtttctaggtgatacaaaatatacttctgtttgtaggatttagttactttattaattggggatacttaaaataataaatgaataaattatagcagataacttctcaaattctactcacccaattccagtttaaattcttaattattatataaatttttattttggaaaaaagacatctaaactcaaaaaatatcctaaaaggcattaattctcaatgcacatgttacatgccagagctgagaatattggagattttttgtcaaaatactgggagcttcaaaaaagttgtttagtggctcttttggagtccaggtatgaccaacaataatatagtaatgataccactctagccacctcactaaagatctttttggaaatattctcactgtcacattgtagaaaatagtaattttattgagtattttaaattccaaatataaatcttctgttatggcactttttcagaggagatgaagaataagttttgtctatcctgaactctcctagttttatgatgacctgctgttctgagtcttccatttctatcagttgccataatgctgtatgttattttttcttttataggtagtaactggaaagtttttataatcaccagtgacttgccagatgcagggaccagctcacagatttatattattctgtatggacaacatagaagttcagcccccatatatctttatggaacagatggggctcgatttcaggttggccatgaagacatatttactgtaagtaataaaactgagtataaactgttaatataagtgatacacctagtaggtactttggaatgaacatagtctatccctttagtaacaccatgtgccctgtagaagatcattcaaaaataatttatggaagtttttgctcaagcagatttaacacaagtaaatctgcaatatgggaagagacagtagctagagagaaatactagatggtaaacacttatttttatgtggacagacatcaggagcaagggcttatgcctttctggctctccagataaggctcaaagtcaagctcaaaaagggaaaaataaaattgtcaaacaaggaaggcaaaaaagttgtcatcaagttgttaattactggtttttattaggtattagttatcaagttattagaccatggctagacacatggagatcagggtctagagggaaacagaggtaacaaagatgaagcagggagaccagtgccatgttgttaaactgaagtcagatacattagcaaacaaaggcaagacttgaagtgggtcaagcacctggcacttacagatgcttagtaatgtctgttgaataaattaatggatgcacagaaggattggtttgaaccaggtggagacagagtaaaatcaccatgaaaaaagagtctccttaagtattgcaagtcttcacaggacagccatctccatgtgatcctgggtgtttggtttactacaaccacaggagaggctgaaccatttggaaacattgttcccattagattagtttgatctaacttttccatcctatatgagtcaatatttaaagacactcttgtgtttatagtcactaaaaggaaaagattttgtcattattttctgtgagtaagaaataaaaatagtctgagctgttgttgttttactattttagtgtttcatgttttcttttaaattgaattatatattcacatagtttatagggctaaataattttcaattctgtaataagaaaggaacacccttaacccctcatttttatagtttgatgcttcttttttctgaatgctgctactaaatttcagctctttctgttgtcactcttgcctgagttctgggatggctacattaatctcttgttgtagaggtgatggctttattaaatgcagtaatttcatgccaattttgatcacagtttcgtttgttctaatgaattgttttcttgtaagggttcttaggcagactgttttacatcttcctttcctttttccctgtactttctttgtatagaccttttcttttcttttttattatggtaaaatacacaaaagttaccattaaaaaatttttaaattgtacaatttagtggcatatagtacattcacagtgttattcaacaatcactatctactttcataacattttattcactccaaaagaaaactttgttatgcagtcactccctgttgcctttctaccaacccctagcaacctctgtcttgtcttcccttcctttccctttctcttccctttcccttcccctcccccgtctacctccctcctccctcctcccctcccctcccctcctcttcctttcccttccctccccttccctttcctttcctatttggatgttttaaattttttcttattgctgaattgctgtagctagaactttcagtacagtgttgaatagaagtagcaaaaattattat

SEQ ID NO: 1779 - DNA, 40947 bp, Homo sapiens
  OR52K3P gene - 4452615 - 4453561 of chr11; NCBI Entrez Gene ID: 390035; Build 35; sequence includes 20,000 bases upstream of initiation codon and 20,000 bases downstream of termination codon of the gene
taagaaaaaccataggggcagtaaagtatttcttggtggtcagggcatcctggaggttgaaaaggtgtgggtgagctgcacaattgagtgcgaagccagtgtggtcctgatctgcagttctgtggtcacctcatatggcttacgctggattcctgtcgtggggtttacatcaacatgccaatgctaagagggacctaaattcactctgtggaagcagccagaggtggatgaagcaaaagcaaaggagtgcaagaaacctccagtaagggggttgagcctctagagtagagggtacaagaaatctctagtaagagatgttgaccccccacttaggggtcacactcaggaaacacctaaagcttctaggatgggaaatagcccaagcaagacaggataaaaaggaaaagatgggcaataaaatacactcagatagccctctaggtctcgtgttaaaatattggaaggataaggaaagaactaaacagaagaaaaagcagcaaatgataaaatattgattttttatttggaccaaagaacctatcctcaaaccttcaagtcttctagccaaagtttgggtctagtgaggaatggatttgtcaacttttaatagagtatgtcaataacaaaagtcctatctccctggaggaaatagactatgccttgtgttggtggcagaggcctgtcatcctctagtccataaaactacaggacacaagccagaaactacttcctctcaagaaattaatatccctcaccccaaaagtgtaacacgtgggctgccttagaccaacttcccccaccaaacttccttccccctcctacagaccaacttcctcctccaaacattactaacttccctccccctccagcagttgcaactgcctcaaactcttccccaactcacattgtcatttccctcccttatgaccctgactcttggggctgtccccagccctcccttaggaaggcttcaacatgagatagaacaatgtaagaaggatatccaaactttcctttccccactacctctagaggattggctgcaaacctttttcccttaagggaagttcctctaggaggagggggcattggctttgtgaatgtccccttaaccagttcagaagtccaaagcctgaaaagggaactaaaaccactcttagatgatccctatggagtagcagatcaaattgatcaattcttaggcccccacttgtatacttgggccgagttaatgtacatcctaggcatcctcttttcggaagaggaaagaagcattatctgtagggctgctatgaccttttgggagcgtgagaaccccccggtcaaaacatccctgcagctgaacagaaattccctcctcaagatccccaatggaataacaatatagcctattgaagaaatatgagagacctaagggaaataattaaaggaattagagaattggtgccctgcacccagaatattactaaagcctttaatacacaacagggaaaagatgaagggcccatggaattcctcaacagacttaaggaacagatgaagaaatatgcaggtttagatgtggagggcccacctggacaagggatgttaaagctccactttgtcagcaatagctggccaggcatcacaaaggaattacagaagacagaaaattggaaagaccattccatagaggaacttttaagagaggcccaaaaggtatgtgtacggagggatgaagaaaagcaaaagcaaaacgcaaaaattatgttgtccaccttacaactccctaacaggcagcccagggaaatagaacttacaaatcttctaagtccctggctgtcagaccctacacagaaggaaaagggatcaagccagacagccatgaaatagagaaaagaagcaaaataaatgtttcaaatgtggaaaaataggtcatattaaaagagaatgccctgaatgggaaaaagaaaaggaagttattccccttatggcttttgaggaagattaggagggtcaggggctctgtcttttctatattgagttccaccaagagcccttgataaatttagaggagggacccaaattcaagcttattacctttttaattgactcaggggcagcttcctcctctgtttatcattccccatctggtgtaatttgttcacaagaagaactccttatttcaggagtgaagggagaaggatttaaagcaaaacctttagaggaaacaaaagtcatatataaaaatagatcagctaatatacaatttttgttaataccagaggaaggaactaacctaataggaagagatttaatgctagaattaggcttaggcctctatgttaaccagggaaaatttctcacctctctaaacttactcactactatagatgaagagtatatccatcctaatacctggtcaaaagaaggaaatcaaggaaaattatttgtttcctcaataaaggtcaaattaaaaactcttggggaagtagtaagaaaacaacaccctattcctttaaaagctaggataggtttaaaacctataattgaaagccttgttcatgatagacatcttgaaccctgtatacccccttataataccacaatattacctgtaaagaagccagatgggtcatactggctagtgtaagacctccgggctattaatcaagtagttcaaactacataccctgctgctcccaatccttacaccattaacagcaaaatcccacctaactatgaatggttcactgtaaaacctgaaaggtgccttctggacttgccctttagtggaggacagctgggacttgtttgcctttgagtgggaagacccccgatctagtttaaaacaacagtacccatggacagttttaccccaagtgtttacagactctccaaatccttttggtcaaaatttaaaataagtcatagaaaaattttccttgccctcatgcatatgcctactccagtacatggatggcctgcttatttcaggggaaaacaaagaatgggtaacagcattttcaatcaacttccttaattttctaagagtagaagaattaagagtctcaaaaagtaaacttcagtttgtagagcctgaagtaaagtacttaggaattttaatcagcaaaggcaaatggaggattgggtttgaacgaattgaaggtattatatccctacttctgccagaaacaaaagaggagcttagaacgttcttaggcttagttggatactgttgcctatgggttgactcttatgccctagaaagaaaactgctataccaaaaactcaattcagagggagtcgcccccacttatctggacccaaccagaaatgcgacagatagaaaaattaaaacatttactagtaactgcccctgttctcattctaccctccctagagcagccatttcatcttttcgtcagtgtaaacaagggagtggctttaggggtactcacccaagatcatgggggccaccagcagcccatagcctttttgtcaaaaattctagacccagtaacccatggatggcctgcatgtgtccaatctgtagcagcaactgccttgctaacagaagaaagcggaaaattaacctttgggggaaacctcattgttagcacacctcaccaagtcagaactattctcaaccaaaaggcaggaagatggcttactcaataattttaaaatatgaagctatcccaccattagaaaggatgacctagcactaaccactaagaattccctaaatcccattgctttcctaataggaaatccaaacccagaagtaacagggaactcacacccaaagaaaccatagcataaatgtttagacctaattagttgccaaaccaaagttagacaagacctatgtgaaactcctcttcaaacagggaaacatcttttcatagatgattccttccaggtaattgaggggaaaaggcataatggatacttcatagttgatgaagataccctcacaaaaatagaatcaggaagattaccaaatgactggtccacacaaaggtgtgagctatttgccctaaatcaagccttaaaatttgtacaaaatcaggaaggaacaatttatactgactctaaatgtgcttttggagtagtacatagttttgggaaaacctggactgaacaaggccttatcaacagtagaggtcaaaacctagcccacaaagagttaataatacaagcattagataatctccagctgcctaaggaaatatgttgttcatgtcccaggacaccaaaagaacctctcctttgaaagtgggggaaataatctagccgatcaaatggccaagcaagctgcctcttcccaagctgcacccgtttttcatttaacccctcaccttccccctacaactgcactccccatcttctcccatgcagactaggaaaagctaaaaaaaatcaggagctaaagaaaacccagaaggaaagtgggtattaccagatggaagggaaatgttatctaagcctcttatgagggaaatattgtcacaacttcatcaaggatcttattggggtcctcaagctatgtgtgatacagtccttagagtctatgggtgcataggaatatacaccctcaccagacaaatagtggagggttgcatcgtgtgcagaaaaactaattaaagggggccagcccctccacacctgtgggtatttctcatcaggtgggatgagagactgagaaaagaaataagacacagatgaagtatagagaacactcggcccaggggactggggctcagcatacagaggaactgcacaggcaccggtctctgagttccctcagtatttattgattactattttcactacctcagcaagaggaagtgacccagacaggatgctgcaaggcgagtctgaattgctccttcactgtagtgaactgcaggttgggcaataatgggtgctgctggccaagtcgcagtgagcctggtttcaggctccctcctccagcactcacttggctgaggaggaggtggccttcatggttttagtcctgatggccctgatgtttctggaccttttccttttaattttaatgtttcaggatatattacctcctgtaattgcttgtagtcaacattttgtgttgaccgagccattacagactctgttacatttttacaatgtgaactttccattcctttcttgaactctgtctctgcctcttctttacaatctattacacagctctcaggggcatcagaaactgaaacactatcttcttctatttgaaacggttttaaagttgctttaataatggcccaattattccatactgtaagtgggatgattttaccttccctacttgcttgttttaattctttgccaatttttttttccaatcttttagatctaaagttctctcttctggaaaccatgggcagaattattctattgtttgaaatagcataattagattttctgtagaagctttaaggccccctcttcttaaaagaattttaatgaagctgagataagaggcatttttactttcagtttttcccattgttaccatgggttcctcccagcacacaagcttcctgcaaggctgaccatggacgtacttgggaatctgtcatcgactgtcctcaatgctcatgttcttaatgtatcttcaccctagagaaaggcatctacgctgggcggcagatgaaggaggccagcccctccacacctgtgggtatttctcatcaggtgggatgagagactgagaaaagaaataagagacagagctcaagtatagagaaagaacagtgggcccaggggaccagtgctcagcatacggaggacctagaccggcactggtctctgagttccctcagtatttattgattactatttttactatctcagcaagaggaatgtggcaggagagcagggtgatagtggggagaaggtcagcaaggaaacatgtgagcaaaggaatctgtgtcacaaataagttcaagggaaggtactatgcctggatgtgcacgtaggccagatttatgtttctctccacccaaacatctcagtggagtaaagaataataaagcagcattgctgccaacatgtctcgcctcccaccacagggcagtttctctcctaactcagaattgaacaaatgtacgatggggttttatacggagacattcagttcccaggggcaggcaggagacagtggtcttcctctatctcaactgcaagaggctttcttcttttactaatcctcctcagcacagacccttcacgggtgctgggctgggggacagtcaggtctttcccatcccacgaggccatatttcagactatcacatggggagaaaccttggacaatacccagctttccagggcagaggtccttgcggctttccgcagtgcattgtgtccctagtttatcaagcctggagaatggcgatgattttaccaagcatactgcttgtaaacattttgttaacaaggcacatcctgtaaagccctagatcccttaaaccttgattccatacaacacatgtttttgtgagctcaaggttggggcaaagaggttggggcaaagttacagattaacagcatctcagggcaaagcaattgttcagggtacaggtcaacatggagtttcttgtatcttccctttctacatagacagagtaacagtctgatctttatttcttttccctgaaactaaataagcaaacctcaaaaaggcaacctcccagggacgaaatccagggttaaggccattccaaagtgtccaagttgattatactgaaatgcccccaataggctgcctcaagtatttactagttaatagtagaccatctcacccactgagtagaagccattcccttcccaagcacaacagccagtaatatagtcaaagctctgttggaatgtatcacacccaggtttggactaatagaaaacattgatttggataatgggacccacttcactgcatacatcattaaggggctagcccaagtattagggataaaatggaaatatcatactccctggcacctgccctcatcagggaggttagagagaatgaatcaaactctaaaaaacatcatttaaccaaactaatctttgaaactcggttaccatggacaaaatgtcttcccattgccttactaagaatctgaactgcccctaggaaagatcttggcctgtccccttatgaaatgctctacgggctgccctacctaaattctactactgaccttcctaaatttgaaacaaaagatcagtccttgaaaactatacatttggtctgtcttctagcctttcctccctcaggactcaaggcctcctagtgcagactccacccctcaaattcccagttcaccaacaccaacccagagatcacgtccttgtcaaaagctggaaagagggaaagcttgagcccacctggaaaggaccttacctgatgctcctcacaactgagacagcagtctgaactgctgaaaaggggtggacccatcatagccgagtcaaggtgtcaccctctccaaagccatggaccatcattccagggccaactcccaccatagtaacgttaaaatgaaaagtctaatctgtccctatttcctcttctttttcctttagttaccaaggacaccttatcatcaatgtaacccgatcacttttcccccaaacaattacatttgatgcttgccttgccatatcttgtgtggacctaaaaagtcaaagacagctcagttcttcagaaaagtatctttgtccctccgggaggacagtatgggccctcacttattatatttggggagaggttatatggaccaccaagtatcagggctggactgcaaattctgccctaaagccctacctccacctcaccaaaggaaccaccttccccatcccaattgccaaacacatcagtgcaacccaatacttatctccattactacccctacctccagtaattctaaccccaccttagagcacttctatggtttaggagcagatataactggaaaggaccctgtgggtttctttgaaatgtgttttgtttctcctcctccaccctctcaccaaacccacaaaatcaaactatttctcgcttcacatcaaatgacaaaactaaggtagctatagtagaagtcaatgacctaaagcaaactttagctattgaaacagggtatcaagatgcaaatacctggctagaatggattaaatattccatctgtacactaaataaaagtgattgttacgcttgtgcaacaggcagaccagaaacccagattgtcccctttctacttggatggtcctccaaccacccaggcatggactgtatggtagctctcttccaaaaccccacagcctggggcaataagccatgtcaaaccctctcactgctattcccagaagctaaacgtcctgcaggtcagcccccgagggccatccatccaacctccagctataaatgccaatttcacctcctgtctctcacagcaggggggaaatgtggcattccttggaagcttaactggatccagtgagtctaaacctttccaagaactaacccatcagtctgcccttgttcatccctgagcagatgtatggtggtattgtggtagacaactattgggtactctgccaagtaactggagcagcacttgtgttctaatacaattggccatcccttttaccctggcatttcatcaacccagcaaaaagaaccaccaccacagtaaaagaagtgtccctcatgggtcttttgatcctcatgtttatatagatgttattggagtgccccagggggtaccagatgagtttaaagcctgaaatcaaatagccacaggatttgaatctgtattattctggtggtcgactataaacaaaaacagattgggtaaattacatttactataaccaacaacattttgtcaattacaaaagagatgccattagagaaatatttgaacaactaggtgccaccagccagatggctggggaaaacagaatagctcttgatatagtagctgaaaaaggtggagcctgtgtcatgatgggagttcaatgttgtatttttattcctaataacacggcccttgatggaacaattacaaaaccattgcaaagccttatcaatttagaaaacgaattagctaaaaattctggaataaataacccttttacaagtctcatgggaaatggtttgggaagtggaaaggactcttgacttcaatatttacttcttttgcaattgttataggtgtactcattcttgtaagttgctgtatcataccctgtatttgtgggttaatgcaaaggcttctagaaccactctcacaaaagccttcctccactctcccccaccctattcagataaattcctacttctaaactaccaagaggaacaaccaagccgaattacgttaagacattttgaagagaaagaattataaaatggaaaagggaaaatttgttagaacaatttcctcttcaaaacttaactctcttgttgtaagttgtaagactgtaaattagcccttctccctgcttcagtcttcaaagtcctcatctcactaccttatttggaaaaagtttcaaatttccttgttgtctctgttctgtgaccaacccttcctgccttgccacacccagacatgcccagacatgccttccctcctgcctagttagtaatggacatctcttcctcccctcctttcgcaaagtgcgtgtttaccctatctggaaaagtttaagtctttttccctatttggagaagtttaagtcttagccaacctggatagcttagattgtaaggtccaactccagccaatggggaaaggacacaaacaggaattgcgttagggataaaaaccccttttctcctttgtttggtgtgctcttgcaattgtggctgatgcaggttgcaccattctacagaagtaaattgccttgctgagaaaactttttgcctgagtgctggttcttctttgcagtatcaagcatttgtttctaacattgggaagaggctggacaaatttggaggagcatcttaaaagcctagactctgatgagggcttagaggaaataaagattagggaacatttgaaactctttagagattaagtggttgtggccagaatgctggtaaaaatatgaagtgtaagggccattctgataaggtttcagatagaattgagggacaaattattgaaaacaggagtaaagatcatcgctgtcataaattggccaagaacttagctaaactgtgttcatgcccaagggcttcgtgaagggccagacttgacagtgataaactagggtacttggctgaagaagtttctaagcaaaatatagaaggtgcttcatgggggttaattttggccccttacactgagattcaggagcaaaggcataatttaaaaacaggatttatgattaaaaggaaagtaaagtggaaagatttggaaaactctcagcctcttgatgtaaagaatgaaaaagtgtgctcaggagaggaaaccaagagtgtagcccagacgtggtttgctacagagattaacatggattgaaaagaaccaggtgcattcctcaagacaatggaagtataatttgagagaccaaaatagatgcccctttatcaactgatatggaccctaagtttaaggaaacaaaagttacctactggttgaggattcacgcttgactggcatggtaacttcctaaattccttatggctacaagaagaaccacactcttgctaatctccctaacaacaggagctattaggtagattgtcaaacctttcctaagtgatttacaacccaggccactacaattctgattagacagaggacttgccttacactctttcctgattaacaattgcagacctcaagccagtttcagcaagctcataactgtctttgtgtcctatggtttgtcttttgacaaaaggcaaaaataaagagccaagttctgcctcattttaatgctaaaacctcactccaaaatgaacatgagatgtatattccatatatctttacccactatgcatatgctcaactcccctcataaatatgtattagctttttctccaaacctgctgagtatgtatgactatcgtgtaatacacaccttgtgaagcataaaaaccagtctgcccttttcctcttcagagagagaacctttggtacaagttagagactatcttttcccggtttgcaactaatattgccaataaaattcctctattatttagccattgtggtggtcttttgcatgacagaagaaagaccctgaaggcgtttcaaagatagttgaggctgtcactcctatcataggtccagaagcctagaaggaaaaaatagtttccagagagaggccccaggcaccctccaaaggtttgctacccagggctgtcttgggattctgctccctaatttactctggctcagtgcttctcagctgatccagctatggcccaagcagccccaggtgcaggtcgacttgccctttaagaggatacaagccctaagccttggcagtgtccatgtggtgctaatgctgcaggcttgcagaaagcaagagctgtgaagacttggcagtgtccatgtggtgctaatcctgcaggcttgcagaaagcaagagctgtgaagacttggcagtctccatgtagatttcacaggaagttgattacaacgtgggagctggggcagagacttgtggggcagagccactgcacccctgctaagagcccccactagagctgtgctgagtaaaaatgtggggttggagctgctgcagagagttcttaccaggatgatgcctagtgtcatgaaagcaggacgccagaactgtagcgttaccagcagcaggcaatgcctacctgggaaaccctcagaaacctatagaggcagtgttgtgtggagtacacagcaaagccatagggtggggctgcctggggctgccaggaggctttacataaagtgaaaagcaattattgtctagctttaagatgtaatgtctgccctgctgggttttggccttgcctggggcacgttattcctttctttttgcctatttctcccttttggaataagaatgtctgtcttatgtctgtagcatcaatgtatcttggaagtagataacctgttctgatttcacagactcatagatgagagtctgcactttggacttttgagttggtgctggaatgagttaaaacactggggctatagagatagcatgaatgtatttgtatgtcagaacatgagttttagggggtggggcagggcagaatgctatggtttgaatatttgtccctgccatacaaatctccaatgtggcagtactgagaactggggcctttaaaagcagtgactgggtcacatgggctctgccctcatgtatgaactaatctattcatgaatagattaatggattaacaaaccagcttgttaacattgtggtgggaatggtggctttatgagaagaggaagagagacctgaggtagcacattagcatgctcagctccttgctgtgggatgtcctgtggccccttgagactgtagggaggccccaccagcaagaatgacctaggccccatgatcttgggcttctcagcctccatgactgcaagaaatcaattcctttcctttataagttacccaatttaatggtattctgttataagcaaaagaaaatagactaagacaggaaccctggtaaaaagcagctttcttctcaggtctttgaaaaatagacattcaagtcagttgtaggcagaaaggtcaccctttatcatttatagaggaacggtcattattcatacacattcacatttatactgtcatctcaattatgtacataaatttcccatccattctgtaagttatgataaattgggaatattatctctactttagagatgagaaagcagattaagcatcagaaaatgccaaaccaaggtcacaagtgggatgttaatgtagcgttcagtttaatatagaatatgcacgcaaaatagaacacctaatggatgaccttggcctggtcagactggaatcattaccctttcacgtcacattgggataggagctgcctgcagtgtacacattctagtgagttggtctttcttttgagatactgcaagtatgatagtaaaggtaaggagaggcacagcaaagtccaaggtgcaagccagctccactgaaaatgctcacagcttctgggaagtagggcatgatccctgggaggcatgactcagtgctattaaatggggcaggaaaccctcagggtttgagtcctgggtcaggggagtccccttataaaggccctgagagatgaggccagagccgtctgtgatccctgaggattctcctcaagtgcagcagtttctgcttccacagccttttgggaggagggcagaggttggtgaggataaagccagctgctatttgcccaggttcttccttcccaaactctttagactagaaaaggaaggtggcactggggctgcatgagctaagggaaagagcccagaattttaagtcagactgagaagtgtgaacagagctgcaactggggagaaagaggaaagaggtaacagttgcggtgagcaggaaggtgggtgggggcactctcagttacttcccacacctcaccctctgcccaaaccccatatttcctcatctttgccctccaacagagggaagagaagtcttgatagtcccacctaactggtttgtgtataaaccccagacacttgccccaccacagaggatgcctgcttcctttctgtgccaaacactgtgggccatctccaagagctcttagctgattattccagtttggatccagtcactgcttttcctaagtcccaccagtgtccccatcccagttaaagggcttctgcattagtcaagaggaagaaaatggggcctgaactagataaatgtcagagaaaggtaaatacatgtttttgaggttcttctaccagaagcagtcttgaagcaccttgcatatgtgactatccttccttgtctggttcttaatttttcaaatctgtcattctgatatccttttaagataaagctgtaggcaaccaaatagatatcagtattaactgagtccattcagcatatggaggcctcttttaaggagttctgggagacataaacagacaagtcctttgagcatggatatcttagttctgaaaacaatgaacagtctggacaaaattttcactacagagcaggtcttagattctggatattaggggaagacgactggctccattcacgctcctactctgagtccttcattctgaaaggagttgattttagatgaccttcaaaggaaataagatttatggacttggacatcctgtcttttccagaaaaatttaagagatgccatccattttctatgtgtgaggatgggcgagcaggtctcaagatgatcagtgatgttcagaagttgcacagaggaattcaagggggatatgaagacaaagtaaaacatgcttggattgaggaaaatgcatgtttacaaggggagatgtacaatagctgtgtttttttttatcccacaggttcgttatgtaccagcaaatgttcatggtactgaagatataccagttgaagagaaagaatgttcttgttgtcatagtacctatttgctacgaggtcaaatcttgttcctggaagaaatgtacaaatattaatacttaaaacagtattttccattaagaagagaattttattctgatgtaggtaacagaggttattgttgggattcttagaacttccatcctagatgcattttaaattacaagataaccaaacattctgagcttgcatcatatgagaggaggggagtagtaatctgagaacgtcagagagatgtctttcagcagtctagaagtcatgcttcatttggtgaaatgttccacgcttaccatgtatgttagagcctgagtttacagaagggaataggcacagtcctttaacttcagtcccttcactttgtgatttggtgaatatttatgaaaggacagatattagagaataaaagaggaactttgtatacttgttaagattcttttgcagcagtagttggtgatagatgctggtggtttgcacaagggtgatgatgatggaaatagacaccttggagatttagtccgtaggatgatccagtggtacctgctgatggttaaatatggtgcaggaagaatagggaagaatccaggatgacttgattctagattgagcaactgcttggacaggatgttgcattctgagatatgggtggcacaagcagagaagtagttataatttctgcctcaggcatgacaggtttgacatatctgtgaggctgatatgtggggatagtctagtctggagtttacagggaaggtaaagtatttaaattatatttgacatttcaggatatgtttacgtctcaatggtcaaccagaagaaagatgcagtgttcaagttcttttcaagaacagtattcccttttttaattttcaagttttctcctactaccggataatttttcaacagaaaaaaacatgttatttctcccttcttaaaaacaaatttacatataaacacacagacatgcaaacacacaaactcttgactctactgttcacttttagccagtgttctatttacttactggcctttacatccaaactcttcaaaggagtgaaccatgttaaaagacttcaattcctctttcagctattctaagtcaagtaacactttaccttcctctattctagcaaaatagtttttatcaaggcatttgatcctctgtgattccaaaagcaggctaatttggttttcaaattctttgactcatcaatagcatttagtataatcttactaaatcagtgataatgtcctcattaacaaactatattcaatagactattaatatagcacatcaccttaaaaatctttctatattaatacttgtccactatcagagttcttttccaacttctccatgggccccaactcctctcctaccccattcttaacattgagattcagtcctaggttcttttctctctgtgaacacttactatctgggtgctgtttatctcttttccacatatatttcaccatcttcacttgaatttctgatagatatctcaaacttaacctgttcaaaattgaagtcttgacctccaccctccataacttccccatcacagttgggagcaactcctttctattagatgtttatgtgaaaaattgggtctcatctttgactctctgttgtctcacatcctatatccagcctgtcaagaatatcactgacattatttttgaaatatatccccaatcccattacttcccactacatacattgctaccttgatcctgagccaatgttctctcccttccctggattcctgcaatagtctccaggcacttttccccggttctacccttccctatttgtgctattatccatcatggatgccacagaaaactttaaaagtctaagtctcctccctctctgctgaaaacaatgtctttgattctgagagaaatgaggaacctttgcaaagttccacaaaggcctatgaggtcctgtgtgatctggccccagcaccctaacttgattctcctgctcattcacttcatcctagcaggctgcctgctgatcttcgaataccaggtgtttttatgtcttagggcattttctctggctgttccattttcttagactgttcctctcctgtgggagactcctacatcctacattatcttatggctgtctcacgtcctatcatctcccctttttgttgtagccattgctgtgggaaccatttgagtgctggtgtaggttgatagcaccttgctcagctgcatcccaccccagagtttctctccttttttgcatggcacctcggggatctcattcagttattctggtgcatgtatagacctaaaagtgcaaggaaattcaccctccttgggtcgtcccaaggatgtgtgtggaagccagggtgtggaagccagtggataagagttcccctcttctgtgtctagagtggacaattatttggttccttcttaatggttcttcatgtggaactggatacagtgatgactgcattatccagctcgataatgcacctttggatccatattctctttcctgttccactccttcatcctactcttgttcattgtataatttttctatgtataccacttgtctggaattacaggtttggctttttaaagaaacaaagctagtatttcctcacctcatttaatatttgctagaattccctttgccatgaggcctgcaatgatctctttatttcagatttcaacctcccctgctccctgccatggaattcctatcctcattatccttgatcctttttttggtttgttttttaaaatcacggcagtgaacctttgtatattatgatgtaatttacttactatgtccttttattatccttctccaacctttagcaaaattattctaagggatctgttttgttcatgaattttttcttaatcgaatcagcaaaaatatttacatttttattgtactaaatttgccaaatatatttactgaattttatgtgaacatagcattgaacagaattaaagcttgagacatgcaataattcaatattttgaggtagggctgaagcaggagactgaaagaagcagctcctttgatgggtaatgtaagtattaaggggagccaagaggagaaaaggagtttcagaagaatggtcaattcagaaaaaagctgctgaaagatcaacatgaatgaaggcaagtatgtgaccatggcatcatatggaggtcatttctggcccaaatgagcgctttttcaggtagattagaatgtgctaatactacaggaaatttgtgggagttgaatctgaatatgtagacattcctaggtatttttatgcaaagaagagctaaactttgaaaaaatagagaggatataagatcatggaggagaagattataaagtgttaatcgacatagaaaccttttttttttttcttttcaagcataagttttctgtggagggagagacagatgacaaataaggctctaaataataaacgttaggctgggcgcggtgactcacgcctgtagtcccagcactttgggaggccgaggcgggcagatcacgaggtcaggagacggagaccatcctggctaacagggtgaaaccccgtatctactaaaaatacaaaaaattagccgggcgtggtagcgggcacctgtggtcccagctgctcgggaggcttaggcaggacagtcacgtgagccggggaggcagagcttgcagtgagccgagatagcgccactgcactccggcctgggcgaaggagcgagactctgcctcaaaaaataataataataaacactaaataattatacaaaaagacattttgtgtgtaattctagtattctccctacaaccctgagataaaggtagggcagttttattacccatttccagagaagaaacaggggcttgaaataagctatttgccacatcttctagctacgtgaccttggacaatcatgattttggctgaggcttcagattctaaacttttcccgtactttatggaaaaaaaggaacttgttttagatttggatatacaaaacatgagttgcctttgggcatttaggtagaagcaaaaggagatgattatttagaacattaaatttggaaaacgctagaactcaaacttggctgacactattaactatggtgtcttagagatattattttcccaacactcaattttctcattttgaaaaaagaccaataactaagcagttactttgcttactgactgtgctgtctcgatgcattatctcatttaattctcagaagaacttcattaaataaattctaacaagaagaatgcccgggtaaaaactgggcaacttcagtgtttaaggcttttgacagaagaaagaaaaacgagcaagagaggagagaaatattaaaaattgttaagctaaagtttgtgtgtgggggagccagatgttagtctttctaaagatgaaagagttctgtgatgaaaattaaggaaatggaagatggacggagggagacccacatgaacaggaaagttaatgtgagtttagatgaaggaaaaccaaaagagaaggctcttcatcttctcgtaagctgcaggcatagctgtatttttaaagtttttgttaaaagaacctggaagatgtattatagagcagtgccctttaatggagctttctgcaaggatagaaatagtcttgacctaaattgtccaatatagtagccactagtcacatggggttattgagcacttaaattaggtctattgagcacttaaatttagatgctactgaacacttaattttttctgattgaggtatgaatttttaattttatttttgatgactagaaatagccacatttgggcaagtggcaatgccattagatagtatacttccagataagttaaacagattgtatgattaattgaggcactggaattgcagggttcatttgacttatatagtcacttaagccagaaagttcaacagaaaatttactcatatgattgggagttttgtttgattggtaggttgaatggtaacaatgtatgacctaaatcaattgatttaaacatattttacttgtttgatcaagataatcctgtcaccaagaacacaaaacaataccacttctgcattcctttatgagaactgtttagtggtatcaggtctattgatatctaaatatttagatgtcagtaaaaatgagagtttcttgtgggcaggaaccatagattatgcttctccatgtctatgagaacttctagtggattttgtttaaggactaggaatggtaacaagggctcatcatagaaggtgattgaactctctaatcctatgtaccctggatactcttcctagaaggtgaaggagcctatgaagatcaacaaggagaatttccaagagtcatgtcagcctccagtatcacctcaacacatccaacttccttcttgttgatggggattccaggcctggagcacctgcacatctggatctccatccccttctcagcatatacactggccctgcttggaaactgcaccctccttctcatcatccaggctgatgcagccctccatgagcccatatacctctttctggccatgttggcagccatcgacctggtcctttcctcctcagcattgcccaaaatgcttgccatattctggttcagggatcgggagatcaacttttttgcctgtctggtccagatgttcttccttcactccttctccatcatggagtcagcagtgctgctggccatggcctttgaccgctatgtggccatctgcaagccactgcactacaccacggtcctgactgggtccctcatcaccaagattggcatggctgctgtggcccgggctgtgacactaatgactccactccccttcctgctgagatgtttccactactgccgaggcccagtgattgcccgctgctactgtgaacacatggctgtggtcaggctggctgtgggaacactagcttcaacaatatctatggcattgctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtgctagactccacgtttagttcttttcttgtattatggaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctacattctaacagttgaaccctagactctacctaaacactgtcagtgctggtgcacatgcatcctttaggcctatttattccaagtgagacagctctgcttgttagaaggttatttcttcaactaagccagtctgtattctttgacttctttttacctcctcatcctcatggctattccatctcattaaatactttgaagaaaaaccatatcctctgacattttattatatatcacataactctttctttgtgcatagacgtatcttatattttcaacaagaatgtgaattgtttacttatttaataatctagccaagtctatgctatctgctagggatacagactgttaagaaagggatgctggactcatgtttatgtcctcagacagaggatggaataattccaatggtttgtgttctctaaactcaccattccaaggcccagcatagaagaaatatgagaagtcaaagaagatgagatgtgggcgtattgacttaggttttgttctatttcattcaaacttaggtactcaagaattcccttaatattaatcctgagaactgcacctctgatgctccctcataccgtgtcttatgagttgaattttgttcccctttccaatttatatgttaaaatcctaacacccagcacttcagaatgtgactgtatttgaggatgaagtctttaaagtaatacttaagttaaaatgcggtgattaggatgggccttaatccaatatgacaggtgtctatataagaagagaaaatttgtacacagacacaggcagagtgaagaccacgtaaagatacagaaagatggccatgtacaagccaagaagagtggcctcggtagcaaccaattctgcttgggtcttggacttctatcttctagaattgtgaagaaataaatttctgtttattaggccccccagtttgtattaccttttatagaagccctagaaaactacttttggcaccagaaagtaaggtgctactgtaactaatacctaaaaatgtggaagttgcttggaaactgagtaatgggctgaagctgaaaaagttttgaggtgcgtgttaaaaaaggctaagatttcttcgaagagattgtaggtagaaatatgaatattaaagatgcttttagtgaggtctcaggaaggaggaactggaagaaagatgatctatgttatcaaatgaaaaagaacttggacaaattgtgttctagtactttgtggaaagtagaacttgtaagtaatgaacttggatatttagctgaggagatttctaagcaaagtgctgaaattgtgacccggtttgttcttgttgcttatgagtgaggagagagataagttggagaagaatttaagcaaaaaggaatcaggaattaaagactgaaaaattctcagcatatccatattacaataaataagtgtaatttggaaagaatatcaagggtgtggctggataaccattttctaaaaagattaggtatattaaatgaaataaaccagcacagaatgacaagtacttcatggtcccactcatatttgggaggtaaagaaaagtcggtgttacagaagtagagactagaatagtggttaccagaggcttggaagagtaggggggaagagggtatagggaggagttggttaatgggtagaaaattgccctttgggtagaaggaataagttttagtattccatagcacactagaatgacaatagttaataatttagtatagatttcaaaacagccagaggagtggattttgaatgttcaacacaatgaaatgataaatatttgaggtgacagattatctcaaattgattaccctgattttatcattaccagttgtatacatgtatggaaatattgcctgcaccctctaaatatgtacaattaatatgtgccaatttttaaaaaaaggattaggcatgtgtttatgaatacaatcagccatctcagcagaagccaggaatagagatggggctatgcaggaaagactcacaggaatcccttttatctgatagtttggaccccatgaattgcatcagagaccaacatgctttttgagaattttattagcagcagaaatgaacagagttaggatgacatgaaagaaggtagctggacttccgggattccagaggatggcccaatacagctatttagctgcaaacgtgcattatccttaaagaaaagggagaacataccctaaggttgttcagaggttggcagggataccactgccaccacaagcccaaaagacacagatccaggaggttaggctgcctcttccttggttccagagggcagagccagcccattggtttcagaaggccagggtgcctctaacccaggactgagggattagggctgctgtccattgagtcaaaaaggattattctgagccttaaatcaagtgtaatttgccctgctaggttttagacttatttgtgactcataacacttttattctgatttctccctttttgagtgggaatgcctatcctgtgcctgttctaccattatattttggtcacaggtagcttgtctggtttcacaggtttatagatggagggaaattttgcctcaggatggattcataccagagtgtcacataaacgatttagatattacatttagatgagattttgtatttacagttaacccctggaattggggatgcttgtattttgcatgtgggaaggactagactttagggagccagaaggcagggtgttatgagctgaattgtgtctcctttcagtaaactcatatgttgaagtcctaaaccctagtatctcagagtaatatgactgtatttggagataaggtcttcaaagaggttaattaagttaaaatgaagttattaggatggcactcaatctaatacaacaggtgtccatataagaaaagacacaaggagaagataatgtccaagccaaggagagaggcctcaaaaggaatcaaccttgccacaccttaacttgaacatctagcttccagaattgagaaaataggtttctgtattgagaccatccagtctgtggtattttgttattacagcctagaaaatgagtatattttcatacatcatcttccacaaatgcattcttgtacttcattttttgtgacccctttcattgtttcctcagagactactgtttaggaagcatctctatctctctctatattagttatctttgaaacaatctccaagcatttgtcaggtgtggtgtagaaggttggaagctgtgcaggagacaagagtattgcaagaacctacactcttgcttccccttatattccatcactgctcccatgaatccctcagacacaaagacaaatgcctcatgtagtcaacacctcttgattattttgtctgagaatagttggggcaggtgggcagctaaaaaataaacactaagttgtaaccacatataaacaaacatggaaaagagcatgaattttaaaaggtatttccaacaagagaaatcttattttcccattgacttatacggggaataacatcatccttaaggtcatatctatccccagtgaagaaataattttgttcccagaacaagtccagtagtataaggatcccatagacaggtaatatatcaacataacattagcacagccaggattagtcacaaatagtaaaaggaaaattaccttctctatgagctcatttgagtttagcacacaatcaaaacatgaataagaaatatgagtagcctacaggcacatataattttatacccatatagatgggtatatagattaggataaaggaaacttgatgcagttatctaggcctagatgcaatacttctaatcactcaaaaactaggtcatcccaacattccaagctaggacacagaggtgcacatcatccttaaagtaggatcaatgcttgagtataggatcctgttctgcctagcaaccctcacaacaccttcccacctacgtgttcctcaagcaaggagtcttggtgttatctttgatttctttttctctcacagcctggagctaatttttcaggaattcccactggcacttaaaaaatagatataaaatctgatacatctgatttctctccatatatatgattaacacattgatttggaaacaccatcttctctctggatgcctacaatagcatctgtaatcctttctctgctttcatcctcatcatcttgtgctgttcccattaagtcagaagcaatatctaaaaaacatatgtcaaataatgtcaattcactgctcaaccttggcttttattccgagagaaattatgaacctttgcaaagtgaaatccttacatggctgatatggtttggctctgtgtccacacccaaatctcctctcgaattgtaatccccacatgtcagaagaggggacctggtgagaggtgataggatcatgggggcagatttcccccttgatgttctgtttaaaagcgtatggccccgcccccattccctttttcctgctccgctgtggtaagacctgcttgcttccccttcatcttctgccatgactaagtttcctgaggcctcccagccatgcttctgtacagcctgcaggaactgtgagtcagtcaaacctcttttctccataaaagtacccagtctcaggtagttcttcatagcagtgtgagaacagactgatacaaaggcctacaatgttctgtgtgatcacagctaactggaaaaaaaaaaaaagaaagcagcacccaggtatgggtagggcacattatattcacaggatcaacaataagactgatattaatagatacttgacttcaaaaaaagcaagtgaaggcagaatacaattaatatactaaagtggatgaaagaagaattgcccatttaaaaacctattcaaattgaaatagaattttagacagaggcccgggaggtgagtcatctttcacaaacaaagatgactaagataattttacaaatgagcaaaagttgatggaatgtgtcactatatggcctgtaataaaagcaaaaataaaagtagtttttcatgcagaaaaaaaatgatccagatggaaacatgaaaaacctggagggaatgaagaacaccaaaacaaagatgcatatgaatgtaaaagaatctagattttacaaaagaaaagatagggtggggaggatgtcaatgaattaaacagtctaagtgttccaatattccagcagttatctccagcatggtttgagccaatggccccactgcccactcccccactccatgtgcttcttatcctgctcctatgatgtcaggattgcccattcagaatggagttgggggcaaattaaggtgctttgttcacaaaaacactgtctattctatctggctcttgtctggcttttatctggcttttgccatattaggttttggtgaggtgcttttcatacaggctgtatccccttggcctagctgtacattgttaaaactatgtaggaattccactttatcccagcatcccaaaagatcagacttatcatggaggagtgctgagtccacacccttgagggccaactattacagaaggggaagttagttccagggtacctgtgtgggaagggagtgagatgactgagttacagcgttctgagattgcttttaaaaattatggggaattagggtagacaaaatccatggagaactctagtgaaaagcatcttctcaggtccttgaaaaatagcacacattaagtcagctgtaggtagaaagatcactctttatcatttatagatgattggtaatttcctaattattaataaggaatcacattcatagtggcctcttgtttatctacttagatcctcctatccttgtgagttagaaaatattgtaaaagttatctctaccttagagataagaaaaatagatcagggatcagacaggtgccagatcaagttcacgagctggttattaatgcatatctcaggccaatatgaaatatgaatgcaaaataaaatgcctaatggatgaccttggcctggtcaggctggactccctgccctttcaagtcagttctgacaggagttgcctgcagtgtatattttctgatgaggctggctttctttgaagacactgtaaggataaagagtaaggagaggcacagcaaacaccaagacacaagccagctccacctgaaagtctcacagcctctggcaagtagggcatgacccctggtaggcacaactcagtgccactagctggggaggaggcatgggttgtaggaaacaaggatacagtccccttgggtcaggggaagtccccttgcatcaacccagagagaggaggccagagatgtctctgaggactctgctcaagtgcagcagtttctgcttccacagccttctgggagaagggcagaggttggtgaggattaaagccagctgctcgcttcccagcttcctccttctaagactccttagactgaaagaggaaggcggcactggtgctgcatgaagctaatgaaaagggcccaggattgtaagtcagactgaggactgtggatacagctgcaacttagggaaatagaaaacaagtgatgttattggggtgagcaggaaggtgggagtgagctggaaggtgggggcactgtcaatttcttcccatagccattcctgatcttaggcatcagctctccaaccctgttattgcttctactctggtccttcaatagagggaacagaagtctcgatagtcccacccaactgtttggtacacaaactccagatgctctccccaccacagaggatgcctgcttccgtcctatgccaaacactgtgggccatctccaagaagtcttagttgattattccagtttggatctgtcacttctcacctcctgtcattgctttttctaacccctggcaaatgccccatcccagttaaagggcttctgcattagtcaagaggaagaaaacgaggcctgaactagaaagatggcagggaaaggtaagaaataccttatctttgaggttcttctaccagaagcagtcctgaagtatcttgattatgtgattatccttccttgtctggttctaagtttttcagatatgtcattctgatatccttttaagataaaggtataggcaaccaaatagattcagtattaattgagtccattctgggtacagaggccttttttaaggagaaatagaagataaatcctttgagcatggacatcttagttctgaaaacaatgaacagtctggacaaaacttgcactacagaggaggtcttagtttctggatattaggggaagaagactggctccattcacactcctactcagagcacttcattctgaggagttgattttagatgaacttcaaaggaagtaagatttatgaactattagacaccctgtcttttcaggaagaaatctgatagaagagatgcctttttttcttgtatgaagatgggtagacagctcacagggtggttagtgatgtttaaaagttgaatggaggaatctagggggacatggagactcaaagtaaaacatgtgggttttgtggaaaatacatattgagataaggtaaagatgcagcaggtttgtgggattatttcacagtattttagaagagtttcttagacgccaggcatgtttctaggtactgatatgtacttgaaaataaaaatgtctgttgtcataagagcttgttcctgacaaaaatgcacaaacattatgaatatttaaaatagtattttccattaagaagagaattttattctgatgcaggtaacaaagtattgtaatcgggatgcttagaacctccattctggatgcattttaaatgagaagataacccaaattctgagcttaaatcacatgaggggagtagtattctgagaaatatgtcttccaataatctagtagtctgttttatttagtgaaatgttccacacctatgtatgttagaggctgggtttacagaaggaaaataggtagagtttcttaactccagtcccttcacttcatgatatggtgggtaattgttgaaggataaatattggagaacaaagtggaactttgtgtacttgttaggattcttttgtagcagtagttgctgggagatgctgtggcttgaacaagggtgatggtgttggaagggtggaagtgttggaaacgcaatgggcaacgtggagatttactatgtaggatgatccagtgtgcttgctgatgattaaatatgatgcaggaagaaaagagaagaatccaggatgacttgattctaggttgagcaactggttgggcaggatgttacgttctgagatatgggcagcacaagaagagaagtagtcatgatttctgcctcaggcatggcaggtttgacatatctgtgaggaagatatgtggggatatcgagtatggagttggatatcctagtctggagcttacaaggaatgtaaggtatgtaaatttgtgtttgtttcaggatatgtttatattctcaatgatcaaccagcagaccacctagaaagatgcaatattcacggtcttttcaggagcagtattctctttcttcgtctaagtttcaacttttcccctactactggataatttgcttcagctaaagacatgatacttctgttctaaaacacacagacacacacacacacacacacacacacacacacacacagttgacttcgctttccattttagccagtgccctatttacttgctgtcctttgcttccaaattcctcaaaaaagttagccatgttaacaaacttcaattcccctcttatctattctaactcagtcaagtcaggctttgcctgtctctcttctagcaaaattgcttttatcaaggtatccaatcctcttgtgcaattctaaacacaaggccaattgtgttttcaagttctttgactcatcagtagcattttacatggtaataatccacttgttagtaaactatattctatatactaagatagtacattatttggggatgtttctatcttaatagtttccactgtcagtttcccttgcgaatatctcagtgtgctccaactcttctcccatccattcttaatgttgggattcagttctgggttctctagttctcttttctgtgaacatttactgtctgggcgatctcaaacagttttgtggctttaaatatgatttattttctatacgtattaccatattcacttgaatttctgatatctcaaactcaccatgttcaaaaattgaagtctcgagctcctcctttcatgctttccccgtctcagttgggagcagctcctatcagtggtttatgccaaaaatcagggtgtcatcttcgactccctgttgtctcacttcctatatctaacctgtcaaaaatgccactgacacattttaaaaatatatccccaatcctattacttcccactacatacactgctaccttgattctgagccaatgttctcccttccttggattcctgcaatagtctccaggtactttcccccaattctacccttccctctttgtgctattctccatcatagatgccagggaaaactttaaaagtataagtcacatacatctcctctctgctgaaaacaatgtccttgattctgagagaaatggggaacttttgcaaagtccacaaaggcctgtggggccctgtgtgatttggccccactgttctgacctgattctcctgctcatttgcttcatcctacctgtgctggctgcctgctgatatttgaataacaggtgtttttatgtcttggggcattttctctggctgttccattttcttagactgttcctttcccctgggtgactcctatattccaaatctattatggtcttctcatgtcctgtcatctcccctttttgttgtaggcattgttgtgggaaccattcgagtgcaggtgtaggttgatagcaccttactcagctgtatcccacctcccacagtttctctgctttattgcatgggcacctcagggatctcattgtgttattctggtacatgtatggacctgaaaatgcaaggaaatctacactccttgggtcatccttgacctatggggtgtggaagccagtggataaaagttcccctcttctgtgtctagagtggacaattctttggttccttctctatggttcttcatgtggaattggattatccatctcagtaaggcaactttggatccatattctctttcctgttccactccttcatcctattcttgttcactgtgtaattgttctgtatataccactggcatgaaactttagtttggcatttaaggaagtgaagccaagtatttcctcacctcattcaatttttctcaaattttctaataaggtgtataatgagctttttatttcaaatttcaacttctcctgctccctatcatgaaatgcctatcataactgccctattccttggtttttaaatcacaacaatgaaactttgtataatatgtaatttaatcatgatgtccttttattatccttctccaacctttagcaaacttattctactaagggatccatctgttttgttcataaatttttccttaacctcttcagtaaaaatgtttaaatagttgtcattaaatttagttagtatattttctgaatgacatggatataaaatttgaaaagatgcttgagaactgtagaaatgtaatacttacagttagggcagaagcaggagaaggaagtgagacactctggagctgggaaacgggaatatggtggtacacgagaaaagtgagttttaagcaggagagtggtcaattcagataaaagttgctcagcggtccagttgcatgaagccaggtaagtgataagggcaccatcatcatggaggtcattgattgtcacagtaaaaggaatttttggtttgtgatgggaataaaatccagattgatatgtttcaaaaccaattatccttgagagagttgagattgtagacctttctacatgtttcactgtaaagaaaagcagaggtttgaataaagggaggaggatttaatgtcacggtagattaatcaacataaataattttttaaaaagtaacagttctacagaagagaaatataagtgacaaagctctgcacactaaggaattatacaaaatgattttatacataatcacacttaacctccctatacccctcagataaagggaaatagcactgaactacctttaacagagaaggaaacaaactagtacataagtgatttgtgcaaggtctaccactagaatatgtggcagtcatgatttcagccaataactttagattctaaacattttccaaatgttatggaaggaagttagttttcagtttggttatgctggatgcaggttgcatatagggcatctagatggaaacaataagcctagttacttaagacatgggaatcggtagaaagaaggactcagatatggctgtctgacactattagctataatatcttagagcaattattatatttcccaacagtttctttttgaaaaagagacccagtttttgttttcaatatttactttgttctgtgactattaagtgtttgaagtacattatctcatttaatcctcaaaagaatctcattaagtggatcctatattttatattttgtataaatatatgttttatacaaacatatattttataattttataacagtcttggtaaaaactgggtaactctagtgtttaaggatctgaaaaaagaacaatgaccagaacaagataaaaaggtgaaaaattgttaacaagaaggatatttggaagtcataagtcagtcttgctaaagatgagagcaaattctcctgtgacaaaaagaaggaactggaagacaggtggagggagagtcacatgcacagggagtttaacatgagtttcagtggagaaccaaaaaaggacgtttcattttctccgtatgcttgcagcatggctgtatttacagagacctgtgaatactgagaagatgtgaaagatatactgtagagcagtggtcttaaacagaaatttctacaatgatggaaatattcttggtagtcactagtcacatgtggctattgagcacgtgaaaagtattttgtataaatgtgaaatttattaagtataaatttaggtttacatagtgacatggctagtagcaaccatatcagataaagtagttttagggaaaatatgcagattgtgtgattaatttgggcattagaaaccaatgggtttgacttatacatggactcaactcagatttcaggagagaaaattggctcttgcatttgggaatttagcttaactgaaaggtagaatggtaccaatgtatgtgctaaagaaatgaattgatttaaacatattttcacttttttcaaggtattcatgacatcaccaagaacacagaaaacactacatatactccattcctttatgaaagttgtcttagaatattaaatatccatagaattgatatcccatctactcaatgagattcaaatttctttgagggtagaaaatatggattatacttctccatgtctatgaaggctgctaggttattttgtttaaagtctagcaatggaaacaagaggtaatctttgcaggtgggatagcacaggttgaactctaatcatatatactgtagaaggtatatatagaaggtgaagaagccctgtaaaaattgacaaggagatttccaggagccatgcttccctctaatatcacctcaacacatccagctgtctttttgttggtaggaattcctggtttggaacacctgcatgcctggatctccatccccttctgctttgcttatactctggccctgctaggcaactgtacccttctcttcattatccaggctgatgcagccctccatgaacccatgtacctctttctggccatgttggcaaccattgacttggttctttcttctacaacgctgcccaaaatgcttgccatattctggttcagggatcaggagatcaacttctttgcctgtctggtccagatgttcttccttcactccttctccatcatggagtcagcagtgctgctggccatggcctttgaccgctatgtggccatctgcaagccattgcactacacgacggtcctgactgggtccctcatcaccaagattggcatggctgctgtggcccgggctgtgacactaatgactccactccccttcctgctcagacgcttccactactgccgaggcccagtgattgcccattgctactgtgaacacatggctgtggtaaggctggcgtgtggggacactagcttcaacaatatctatggcattgctgtggccatgtttattgtggtgttggacctgctctttgttatcctgtcttatgtcttcatccttcaggcagttctccagcttgcctctcaggaggcccgctacaaggcatttgggacatgtgtgtctcacataggtgccatcctgtccacctacactccagtagtcatctcttcagtcatgcaccgtgtagcccgccatgctgcccctcgtgtccacatactccttgctattttctatctccttttcccacccatggtcaatcctatcatatatggagtcaagaccaagcagattcgtgagtatgtgctcagtctattccagagaaagaacatgtagatggatagttctctttttttatcccacttgccaagtaatgagaatgctggattggggttgaggggaaaaatctaaataggaaaattgcagagtatctttgacaattctctagtatgataaggaaaatgaggtttcattcctcacagatctacgagtcaggtcaaaccaggagtgcacctatagtctggtctgatagtagaggtttgaccttcccattgtcatagactcatcacatggctaaggaagacaaacctctcaaagtggtattgtaatctgggtgaaagacagtaggacctttattggctgagattggcccaaacagctgagtcacccaaacaggtgacttctttatccaggtatgagtgaggaaatgtacctcaaattttgtgaccccaaaaccattattccttttagtactgaaattacccccatgtcttttctgacaagtaccctccaccctttgccactctttatagcctactatctcccaattttatttctacagttagacagctccatttataagtagatctatttcttccattaagtcaattcctcttttacttccttcctgatagacatggccaattcctttagtgaacatttatcaaaagagtcctccgatgttcctttttatcaatttatatcatgtatctagcttttcactgcatgtcttttgcctccaaaatacttagtaatatttattaaatgaacggatagaagagctgaatactatctttgaactatgaaccatgaaaagagaaataacacccttccctcttgaagctgagatttctgaaaataagaaaatacaatactgtcacacactgcataatgaagttttggtcagtaatggatcacctatatgatggtgattgcataacattatagtaccgtatatttactgtatgttttttaacttttaagttacatgtacaggtttgttatctaggtaaagccatgttatgggggttttgttgtacagattatttcatcacccaagtattaagcctagtattcattagctatttttctgtttaaatacacaaatacttattgtgttacaattgcctacaatattgggtttgtagcctaggagcaacaggctataccatatagcttaggtgtatagcaagcgataccatctaggtttgtgtaaatacactctatgatgttcacaggttgataaaatcacctgaggacacatttctcagaatgtatccccatcattaagcaatgcatgactagttagacatgattgtagttgtgatagactgtattactgtccaccaatatttagtctcctgtccttctatcatgggtagggtatttccttcactccacgaattttaaactttgctgtatgacttgatttggccaatgaaatttgagtagccctgaaatgtacttcgagaatcagaaagtttattaaaaaaaacagatgctagtgaggttgtagagaaaaggaaacacttatatactgctggtaggagtgtaaattatttcacccattatggaaagcagtaggtgattcctcaaagacctaaaaacagaaataccatttgactgagtgatcctttagtgggtatgtacccaaaggaacctaagttgttctaccataaagataacatgtatgtgtacattcactgcagcactattcacaatagcaaagacacggaatcaacctaaaggcctatcaacagttgactggataaagaaaatgtgatacatatgcaccatggaatactatgcagccgtcaaaaagaataagatcatgtcctttgcaggaacatggatggagctagaggccattattctttgcaaactaaaaggggaatagaaaaataaaataccacatgttctcacttataagtgggaactaaacaatgagaacacatggacacaaagaggagcaggagacactggggcctatttaaggtaggagggagaggatcaggaaaaataactatcaggtactacgcctagtacctaggtgattaaagaacttgtacaacaaactcccgtgacacaagtttatttatataacacacctgcacatgtacctctaacctaaaataaaagttaaaaaggacactatgatattggtgcaaagatcgaatggaaaggaacagaaagacaagaagttgcctggtccatatagacacgtgttattgcagaggtgtgtgatacatatgcaccatggaatactatacagccatcaaaaagaaataagatcacgtcctttgtgggaacatggatggagctagaggccattattctttgcaaattaaagtgtgcattaactttcctgctttctttcccctctgctgcaaaacccagcaaagttccagttagaggctgtgacaaagccaaagtccacccacaatgagtaagaagtgtaaatgagaaattgtgtttgagctgctaaaaaaaaaaaataaactttaaaatatggctggaaagcttatctttcattctttccctctaccagaagaataagcgtatcacagcctagactcatgatgaagatccatggagcagatgtgaatctgactcactgcctgtagcatagtcataactgacccacagtgttcatataacatgaacaaggatgattttgttgtttttgtagtgaaccactgaaatttgggagttgtttgtttcacagccttacccaaggagcaccaattgctggagttgtgagttctatcttgcatttcaactcatgacagctcaagactgaatatttaaaggaaatacagtcttcttacagcatatcataaaattatttcacttatctctgcttttgtctttcaaactctcataatgaacacttcttcagtcagttctacaaaaagaagctcccatacatacttttacatgatctacttatactgtagggaccagccctacagggtctgtgagtttttccccttgtgtgcagagatgagagatcatagaaataaagacaaaagataaagagaagaaaagacagctgggcctgggggaccagtaccaccaagatgcagagaccggtagtggccccgaatgcctggctgcactgttatttattggatacaaggcaaaaggggcagggtaaagagtgtgagtcatctccaatggttgataaggtcacataagtcacgtgtccactggacagggggcccttccctgtttggcagccaagaaggagagagagagaggacagcttacaccattatttcttctatgcatttcaaagacttttagtactttcacttattctgctactgctatctggaaggcagagccaggtgtacagggtggaacgtgaaagtgaaacaggagcgtgactgctgaagcacagcatcacagggatgctggatgctgtggcctccagatggctgtgggtgggcctgactaatgtcaggccttccacaagaggtggtgaaacagagtcttctctaactcccccagggaaagggagactccctttctgggtctgttagtaacgggtgtcttccctaggaactgactactactagaccacagtccactaggtaatgggtgccttcccaggcactggcattaccgctagaccaaggagccctctagtggccctgtccgggcgtgacagaggctcacacttgtcttctggtcacttctcaccgcgcccctttagctcttatctctgtatggcctggtttttcctaggttataattgtagagcaaggattattataatattggaataaagagtaatgctacaagctgatgattaatattcatgtatcatcatatctataatctatttctagtataactattctgattttatgttttctttattacactggaacaacttgtgccctcagtctcttgtcttggcacccgggtggcttgccgcccacatctcccccctttttattaactaggatcaccatcaccatcattgcttgtcattgacttcggacttttcctcagactctttggaggcatctgcaggctaaaagtagacaacacaagcatgccaatattaataatgccagggacaacaatgatcctccaaggggtttgatccatttaaagggattaagatcagataatcctttagttattgtttcaaaaatgtctgagccaggaacagtggttaaatgagcctgtgaggcctcaaaaatttgttcctaagttttgaaatatctaaggttaagttatcatcccaggcttttaaatgtcttgagaccttttcccagctatgttgatctttattataagcataaggcgttatgcagtaatcagaagtattccaatcatgctgtaattgcatacagcattccaaattcgtaactatctcccagccatattacactttggcagagatcattaatttgattagctaatttctgatcaacttgagtcagaatcctagagtctggaggagttttcctgccatgcttcaacatattgagcggtttgaacagaattgtgggttgcaactccagtggttgccgctgttgcagtaaccaaaattacacctgcaatgactgcaataagagtaaaaatgaatctcttagttcttttgaagatacctttaagaacttcattgactatgtgtatagagggggaagactcccatggatgatgtaaagaaactggtatccataccccctcgctccccagcccttaccaagagaatacttgttctgggattaaaagtagcatcaatgcacgtgaacagcttacagttatcacattctatagtttgtgtattgggaatgataattgtatttccaaccaacagcatatgagggggtttgacacatctcatgataggtatcacccgtttagacatcaaggtgatgttgaatatgggtgtcttggtattagtagcaaagagttgataggtagtgttccatagccttattcctgtcatggctgcagctaatttccataattcaggatgttctggggtaacaattggatgaatcatttttggtctaggaggaatgatgcctgtgtacatcaatttaaatgggtaaggagctacccattccctcaacctgtaggactgccatccgtcctctacatattctaacaaataaactctgagcatgtcatattttggctggagcaattccgccaataataaataccctcttggagcccagtcaacaacaacaaccgtaggtagagtttggaacactacgggctttgaagcattacaatcattccatacaattgaatttactaaaaaaggtccctttgtaggtttattggagcagtctggcagtccttttgttattttttgtggtaacaggaaccctccagtcctcatgtggattaagtttaacaatcataagttgaaaagagttggtactgaacacattatgtacctgataagaatcattactcaaggatggtatggtccacatccaattctgataagaataagctaaacagccaggtgacattccaatgcacagtggtggatatttatagccgattgacaaattaaagtgcacatctccttctggttgagctggaaagctgtcatcattaggggctggcatgaaggcactattattagtgtaaacttctactgaggagtccatccaggagacagactgaattaaagggggaaaaggaacatatgtgcaagaagcataattttgagttgccccaactgctggtatactcaccactacactgactaccataaaggcagccagaattatattacctgtttttggaattcctttttcttgtagtaatttttccgtttgatgtgataagacctttatttgaccccatgttggtggagtagaatgactggtattgtaggtcacacggtgagattgtgtcataatgttgaggtcatggaatttatgtgtcaggcggcaaagcttgcctttcaatttctgacgtttcttc

SEQ ID NO: 1780 - DNA, 40963 bp, Homo sapiens
  OR52N1 gene - 5765660 - 5766622 of chr11; NCBI Entrez Gene ID: 79473; Build 35; sequence includes 20,000 bases upstream of initiation codon and 20,000 bases downstream of termination codon of the gene
gtgaatggtagcaagcgctcctgctgcgcagaatgaatgagtccaatctgtggttctgtggtcacctcatatgggggtcccatcaggggtttatgctgacccgccatcaaggctaagaggaacctgaaatattcccacgagggaagcggccagagtggacaaagcgaaaggatgcaaagagcctccagcaggtggggctaaaggataggcgaattgagcctcagttacgattccagtgaaggataggcaagaggtcccctaacacaaggggttgagccacaaggaatccctcgccaaataggcgagaaatccctaatatgatggggttgagccacagcaatgccccgttaggcaagaaattcctaatatgagagattgcgcctagccaagacccaatatgggaaatattacaagcaaaaatggtaagaatagtaacaaagatatataccacctgatagtcccctaagtctcatgaaaaaggatatgaatagtaacaaagatataccacctgatagtcccctaagtctcatgctaaaatgttgggaagataatgaaagaactaaacataagaaaaagcaacaaatgataaaatattgcttttctatttggactcaaagacctaacctcaatccgtcaatcttctggccaaagtttgggtcaactgaggatatactatgtcaactttcagtttaacatgtaaataataaaagcccagtttctcaagaagaactggactatgctcttttttggaggcaaagacctgtcctccctttcccttatgcacctgcccctactgtggagacagtgaaggagggttctcagaggatcctagcaaagaaaacagcacataggattccctggaccatcctttacctaatgcccctagtcccccatctaatacccccaacccttcccctcaggcccagcctaagtcctcctctgtgaaaggaatccaagctcctcattcgccaggtggcttttgacaggctagcgacatcaaggatctgcctcaacatgttgtcgttgtcgtgcagcctctagtgcgcccccacagcagaaaaagcccatgctctgccgcagcctatgcctaagcagactacattatgggacatatgccttacttttgccagggtcaagtaatacaggcttcagatgcggctccaagcagctaggcatccccgcggctaagtttcctgaacaagtagtagataatctttcagctgatatatccgctagcatttattatgggtcaggccagtattaaaagtgaaaatatccaccagaaaagactttgattatttaaagtcacttatattaaaatgtaccaccagaaaagtattacatgtgtataagtacgagtttaaaagtatagtttaacattaatgactgataattcgcttaatctagcaagtttcttaatgagatatccaaagctaaaaagaaagcacacgtgtttagatttaactgattacaaacgttcggccaaacttagaagaaaccctcttcaggaatgattaagggaaaaagaacgcaacaggtgttcagtaattaataaagaagttcctagagaaatttataagctgtctgcacttagtcaagctttaaattacctgcaggaccaggaaagaaccatctgtactaattctaaatatgcctttacagtggctaatacatttagcaaatttcagactggattaatagtaaaagtcaaagccttgttcatgaggagttaatcacccaagtatctattgtccatgtccccaagcaccagaaaagcctgtcttttaaaataacctagcaaatcagataagccgaacaggctgctgtttctcctgtaggcactaaagggaactcagaaaaacattacccattaaagaccccaagcgatgtataacacagtcaaagtttatatgtgtttaggaatttatacccttagccaaacaagtctagagacttggttgccatagatgaaatgtcttctatcttcctattaccctagtaagtccaaactacctcccaaaacaatctactgccaacattcctacatacttggtttatcttccactttctcttccctcagaactcaaaattttccggtacaggtgccacccctaaagttcccagtatattgacaccagcctgaggagctggcctagtgcttcaaaccactgaaactgcagtccaaacagcaagaaaagatggacccatcatacccgagtcaagaaagcaccaccatccccaaagtcatggaccattattcaagggaaaaaacccctcaaactaaagttaaggaaagtttaactctcttttatctattctattaccctttcttctttcctcattctattgctgaccttattatcaatgtaactaagtcagactcatcccaaatcattacctttgaggcttgccttgttatgccttgtgaagaggacgaacaatggcaaaggtatgtctctcctttagaaaaacacctctgccccttcagagaaaccactgacctcacaccttgctcatggtgggggtaccaaggcaccttaagttaggagatacgttctcaatgagcagatgtcatcctgactgccaatgaacacggcgagacctccccagaaggctgtaccaacctaaaatcttacctcctccttaccaaatgaaccaccccctctaattgccaactttaccattgtaacccagtaactatctctattaatgctgctacctctaccaaccatacgcttcctttagaaggcttttacggcttaggggcagaggccaatggatacgaccctgtaggcctctttaaaatacgctttattgaccctccttcaccttctaaactttctaccctgcccaacaacaatgccaaagtaaatattgtagaagtgaaggatctaagacaaactctagcaattgaaacaaggtatcaagatataaatgcttagttgggatggattcaatattctgtccgcactttgaataaaagcaattgttattcttgtgtgcacagcagaccagaggcccagattgtctcctttccgctaggatagtccctcagtcgaccagacatgggctgtatagtagctgttttccaagattccacagcctaaggcaacaaatcatgccaagctctctctctgctatatcctgaagtccaacaccctggaggtcagcccccgagggccattcagcttccacctcctgacgtcaatttcacctcatgtctctcacaacatggggagaacttggcattccttggaagcttaacacgttgcagcaagcttaggcccttccaagagcttacccatcagtctgcccttagtcatccttcagaggatagatggtggtgttgcagtacacccttaacggacactctgccaagtaatgggagcggcacttgtgcttttgtccagttggctatccctttcactgtagaatttcatcaaccagaaaaagaaaaaccacaacactgaaaaataagagaagccccttataagtcttttaactctcaagtttacatagatgccattagtgtcccacgaggagtgcctgacaggttcaaagcccgagaccaaatagctgcagaatttgaatccatatttccacaagtaactattaataaaaatgtagcttagataaattacatccattataatcagcagcagtttattaattacaccagggatgccatcaaaggaatagctgaccaattaaagcctactaaccaaagagcttaagaaaacagaatagcactagacatgttattagccaaaaaggtgaggtttgtgttatgattaaaacccaatgttttaccttaatcccaaacaacactgcccccgataggagcataaaaaaggccttacaaagacttaccactttatccaataaactagctaaaaattctagtcactgaccctatttcaggatggctaagaaagtagttcagtaaacggaaaagaatcatagccttaattcttatttctcttgcaattgtaataagtgtactctttcttgttaggtgttatgtcataccacgcatccataggctaatacaaaggactgtacaaacagcacttactaaagcctcccttagttctcctccaccttattcaagtaagcttttccttttagaagatcaaatcgaatggcaaagccaagacatgttaaaaacgtttgaagagaaagaatcataagaaaattaaaaggggggaattgtaagatacaatgaatttctctgagttcctcttcaaagatttagcctgctaacttccttgtcttttgttctcaaactcaactttcctgttcccccttgtccctagttactgtaaaacagcctacctgcttcccatcagctctaatcaataactcacgtctgttcccttagttatctgcacccactgttcccccgaaactgcacatctcacaggcctcaccactgtacctcaagtcccccttcccttccatatttagaaagatatctgcaagtaacaaatcaggttagctcagactgtgcggtctgaccccggcccatgggggagtgacacagaagtagaaactaccattagagagagaacttcgctgctctcctttgttccctgtgctcttgtgatcttgattgatgtgagtggcacccttctgcagaagtaaattgccttgctaagataacttttgcctgagtgcgggtttcactttgtggcaccgagcatttattcccagaatatttttatacccaacaacaagctatatctatagttttttttaatttaagggaaagcacatttgtcattaatttgaaagagacagaactcagggaaagagtgagataagatattagttatatttttggcttaattttgccagtttagtaaaacacgaaacataactgttagtagagatttgtgagcagaagcagttcctgtggaatatttgctgtattttgtgtcctcccacctgtattgttattttgctccattttctttatctctgcacatgtggcccatctgaaatgattgaccaagtggttctggagattctgtaaaaacaagataatcttccttatactttgtatcactttgtcattttctttttcttcctttcctttgggaatattaatatatctcttagagtttgaaaaggaaacatggtttaacaaattgaaatctcaatgtgagttctttgataccttggttctagatctaatgtaactgtgtgaagttgatgtagaaatattggggtctgtttcagaaagcctgctgatctctgccacccaacacttggtctctagggcacaagatgcaacttaaaataaaatgttttccactatctttcccagtcctcttggtttccccctgcttcccttttatttccttccctcttccctatctgtctgtctgtctctctctcccatctctctctatctctatcatctctgtctctatctctatctttatctctatctccatctctatctctatgtctacctctatctatctctctgtctcttctcccatgaatactaagtagaattttgttctatggccatcaaacttatacttctttttgaaatttctcaaagatattgccctgctggctgtaattcaattttgagtcttagttttcagagtcttttttcttttcatgaaacatacttttgaatttgtaatgatgaagataacaaaattaatttgcgattgttactcattgcctcaaatacatcttatttattgcattttacttatccagattttaaggatatattcttgttttactttgttgctcttgctgttgtttcttcccccaaccccagcataggtctattaacattattgttttcaaattttaattgtaatattctaagattcatccagtctttccacttgtgtaccttatattcttcatttatgtaatgcagacaattatacctatctcatagttttgaagtaaaagtttggtgaaataataaatatgaaacattattataatattagaccatgtatatgttttaaaacaacaatttaggaaaagtaatttattgatctgtttggtagtgttttgaatggcttaaatgaagttacctgataaacaaactttaccaaatgaaaaaacctaattctgagatataaaaactttactattgataagcttatgatttacattacatagagacacttcataattttagcttttttaaaaaataaaactcaggttttactcccagatatgaaaatcttattgcaaaaatatatggtgtgattaatctattttactattttgctatttgactatatataacatgatattaaaatatatcatttatattagcaaataagaatataattttcatcaatataacatcttgacctgcttatccatttatatttattttgtgatcacagtctattacttcaattttctcttggattatgttcttaatatttttctcacgtttaattcaatcttgctattactaaatacatttatccttctaatactaccatgcactttatctctgctatttccagaaatctaaataaagtatagtgttcccacagtattcatgagggagtggttacaggacacgacccataataaaatctgtggatgatcaagtcctttatataaaatggtgtggtgtttttatataacctacacacatccttttgtgtattttaaatcatttctagattacttatgatacctaatgcaatgtgaattctatgtaaacagttgttatattgtattatttgtttctatcatttttatggttgtattatttttttccaagtatttttgatctgcagctggttgaatcccagggtgcagaacccacatataaggagggccaactgtactactttctccattgtccttgaccactctgctgcttctccatctacatgaaactcagatcagtcagtcaagcccagacatctttgattggcaaagtatatagatttcttcaagtcttctttcctctacatctctcctgtcctcaaacaactctcaagtagtatccattgaatctttcaaaattgttcttgacattaactgcaaagagtatttccccaatcgttatcactctagtaaccacatttattgcagcttcatttttgtgtgcactggagcattcatataaatccaaatacttacccaggcagcaggatgtcagagataaatgagcaggcaaagatgtttttctctaaagttatacaagtttcacataaatatagactagaaaggataacaggacatttgagattcagtccattcgacaggtctaactaaagttaagttttgtaaaatgtataattatgtcttgtctattttatgtcttttatcacattgaagtcttgaattaaacattttgtgattatttaataaaatttatggcagaatattcacattttttcctgagttcatagtttttgaatcttacatttattctcttcctctataactttatctttatgctgattcagacttctatatcatagatttatgtcatacttaaaatacctttctctctaaaaaacaatttgatcactccttcacggatctgcttggtcttcactccatagacaattggatttaaggtgggaggcagcatcaggtaaaggttggctataaaaatgtgaacatgatgaggtatggtgtgtcccccaaagcggtgagtgaagaagttgaaaaaggctgggacataagtgatgaaaatagcacatatatgtgctgtacaggtactgaaggctttgtggcagcatctgcagatgacaaattcactacagcacggataatcatggtgtaagacatggagatacagaacatgtcaaaccccccaatcaatatggcagctatgagaccatagatggcattaatctggacattaccacaggataatttggccacagacatatgttaaaataggtgtggtggatgaggttgcccctgcaatagggaagacacttgatcaggaaagcaaatggaatcataagcaacacactttgaatgaaggtgacaagcccaactttggtaattacagtgttggtgaagatggtggaatagtgtagagggtagcaaatggccacatagcggtctagagccataagcatgagcgccccagactccatgcctgtcagcatgtggatgaaaaacatctgcacaaggcaggcattaaagtcaatttccttgaggccaaaccaaaaaatacataacatattgggaacaaatgaggtgcatccagtaacatctgtaagagacagcaagtctaggaagtagtaggtgggttggtgcagggcctcctcatggctaatgaggtatataagtccacagttccccaaaacaacaatgatgtacatgaagcagaaaggcagggagatccagatgtgtgcagcttccagcccaggaacgccactgagaatgaaatatcttggtgtcaggctggagctgttggctccattcatgatgctcaccaattacaaaacatgctagtttttgtgccaataaagttgtcctgtataaggagagagtagtgagattattttcatccagagaaaaaaatataaaaacgcatttttcacaatctaaataataaatttaggaaaaaataatcattttgtatccaaactatgttttttgattctattgaatggtcctatgactgtaactgaaccaacagaataaaaacatattgtaaacatagtgccaaagccctggcctggcttggttttctactggaaactctgtttatatgtgtctgcttacattcctgggccatttagtaatgcttgactttgcaacctcaaccaatttccaaattataaactctatttaagtaacattgattttcttaattcactacaaactatcccttctttcaagaaatactttgagatgtgtccactgggttatagttaatcaaattatgtcagcacctaccaattatgcacttctattatgattcagcttgatctatatacaagtgtaaacctggcaggtctggattttccaagtcagaaaaatcaaggacagagatgggaagggccaaaaaggtacataataagttacaatttataaatcatggccatgtgtattttgtattcgtctctttttgtattctttcaggtttcttgatggtaagcatgaaatatttttgaaatgtttgcatttagctaataacattattaagctctacgtaattttcatgctttttgttaactctcctcaaatctctatgttgataagcatgatatatataagcatgatacatatgataaatccatgatatatatcactctttaagtgtgcttacatatactattaatatacagtacatgtattacctatgatcataattttataccttcttttgatgtatcatttttagcccccaaataactatagacaattatattgggtaggataaaatctttactaattttttagtccagtttttgagaatggttagctttccatctttcttctgaagtctgaaacatgaatctaaccttgtaagcttttctgattaaagtgagactccatagtcttaccttttgtttctttccttctttctttctttctttcattctttttaaaaatatttccccagttattggttgctttagattaccaaattgaattattcatttttccatatcattgcagtttaacaaattattttatattatcttctgttatatgttaatctccttcttcaaagttctaattttgattgcttctctctctctctctctttctctgtgtgtgtgtgtgtgtgtgtgtgtgtgtgtgtgtgtgtccgtctgtctctatcgctgtgatgggatttaacctagagttttctacagagttttttttaaccattaatcagtggaaatcttttcaagtgttgctgtataaataatctcagtatataaaaaagataaaagtaaaaccttctagaaaacaataaaaaatagaactgattatttttaaagcattttgctttaaggcaaaatacttttaatgttaagtaaagtaaaccatgtaatttttcagcacaacctggaacataataagaaaaatacgtaatactatcacaattattgttagtattattatcattatatcgctctacaaaataagtgaaaataaaattatatccagccatcccttaaaacctcctggatacttccgtcttactcagagcaaacaccaacatccttatatttgtttacaaaatcctacacaattagggctcttttaaatatctgaatgtatctcccagtattctaattctcattctctcagtccatccatacctactgaagttttctcaagcttaacaaacatgtacaattaaagatatttctacttgcagtatcaatgcctgctatgttcatcccaagctgtataatgaacggatggatgaataaattctaaaatctcctttttggatggttctcctgcttatacataaataccttaacaaattagtgtcacaataaactttgaaaaataaaaacgtattaggaagacatgatttcaagtttcaagatgtccttaatcttatctacaaaaattaaaaattaatgaaatcggagatatttagaattgggaagagtacatgtagtagatgcatgcaaattgtcttttgtattattttgcatatccccaaaataaacatattataaatagaaaaatgttacagaaatgtaaatttggctttgaggaatgttgcccattcacacagataaaattttctaataagataatgggatcactgccatctgaggtatcaagcagtgggaaaacggcatatgtcattaatgtcgtcaagaacttgggctacatgatcactagaatttcttccaagtgttcttttttttaacttttaagttcagggatacaagtgcaggtttgttccatagttaaatttttgtcatgggggtttgttgtggagattatttcatcactcaggtaataagtctagtacccattagttattttttctgatcttttccgtcttcccaccctccatcctaactcttacactaattcattttcaatggtagagatgttactgcttcctgaggaatactcttccatctatggagggcagagaagtttttctattattgtatagaaatatgcttgcctatatctctttggtccttgtcacatcagcctcatggaatccccttccttcaggacctaaactacatttaattttctccctcttctccctcctcaaggcaatttgcaaattccttggtttcaaaattctaaagagtgaagtaattcagaacttccttattcaactgctctctcatttaaatccctcctatatagtagcaattttgtgcattttatatatttgttttctttttatctgaaccattttcatccaaactcaccctggtgccagatgtttttaaattcccattcatgactgatattacttagaaataattgcacaatattgatgaggaaccctatgtaacaaacttaatatcttctctggggattttccaagccaaggtaaaaaaattctttggggctttacagatagatgtcccataggtctctgaaaaggaggtgaatttacctttgttgaaaatagatctataattagaatatgtctatgcctgacagaaaaaaatctcaaattttattattgatgggacatgtgaagtgtctagcatctattgaatcataaacctggaattttacctgactccctagggcagttccattccagtttcataacattttatatatttattcatgtgccatgtgggtattttaaagctttctcaaaaatattgagtaaacaatttcagaatgttttatgctaggggctcattaaaatatatattctgcaataaggctgagttatgtctttatttgaaaggttaacactgttaaatgcactgtctctccatcactgttcccctttacttcagtagaaatatagcattcttttctgttgcaatccccgttagtacatcttgatcaagtttaaggaaacatcaaaggctgggattgaaattatcctcaaagtagacagatgtctggaaaggaatcaaagaacatcgtgaccacaatttaataccttgggtttgtagaatgaatgcagtctatggagaggagaaaacggtaaacagtaatatgatgtaatggcacatctttcttctagcacaagcagctacgatggacagaatccccacaaatgtaggtccttttttctttttcagtgagccagctcgcttaccgaaacacataaaataagctctatgccatagagcttcagcccagagtgagtcttcaattattaacaatatggtggtgtgtagctttattccagagcagatagctaataaatgaaaaacatagatgtcagctttccttttaaaacttgctgagttacaatattaatagcatttttaaaataatacttaaataaatagtaagctatcagatgctaggtaatgcttcaagtcctagactctgctacaaagttcctcaagtcagaaaatctttgaaaaatatccttacttcggtttttttttttgctttttgtttgttttctgaattaaaactgtattaagcaggtatatctgcttataaatgctatgcatatataataatatacttatgaataggtgtgagaaattaaaatgaagtctatttatctggttataatacaggcataccttagacatagcacagatttggtttcagaccactgcaataacgtgagtcacatgaattttgggtttctcagtgcacataaaatgtatgtttacactataccatggtctattaagtatacaatagcattatgcctaaaaaatatatagacctttttaaaaatatgctattgctaaaaaacgctagcgattatctgagccttccgtgagccataatctttttgctggtggagagtctttgactgctgttgactacttagggtggtggttgctgaagtttggagtgattgtggcaatttcttaaaataggacaataaatgttgccccattgattgacttttactttcatgaaagatttgcctgtggtatgtaatgctatttgatagcattttacccacagtgaagcagctttcagagttaatcctctcaaaccatactactgctttctcaactaaatccaggtaatattcaaaatcctttgttgtcatttcaacgatgttcacaacatcttcaccaagagtagattccatctcaaggaaccattttctttgctcatccacaaaaatcaactccacattattcatgttttatcatgagattgcagcaattcagtcacattatcaggtttcgttttcaattctatttcttttgctatttacatcacatctttagtgatttcctccagtaaagtcttgactccatcgaagccatttataagggttagaactaacttatttctaacccctattaatgttgatattttgacctcatcccatgaattataaatgttgttaatggtatctaatatggtgaatcctttctagaaggttttcaattgactttacacatgcacatcagaacaattaccatctatggcagctatagtcttacaaaatgtatttcttaaataaataagacttgaaagtcacaattgcttcttgttccatgtgctgcagaatggatgttgtatgagcagccttgaaaataaattaatctccctgtacatttccattacagctcttgagttgccaggcacattgtcaatgagcaggaatattttgaaaggaatccatttttcttgagcagtaggtttcaacagtgggcttaaaatattcaataaaccatgctctaaacgtatgtactgtcatccaggctttgatgttctatatagagagcaaagacaacatagagttagaataattattaagggccctaggatttggggattggtaaatgagcattggtttcaacttaaagtcaccagctgcattagcccctaacaagatagtcagcctgttctttgaagttttgaagacagacattgacttatcctctctatgatgacatgctcttccaaaagaaggctgtttcagccagacacggtggctcatgcctgtaatcccagcattttgggaggccaaggtgagtggatcacttgcggtcaggagtttgagaccagtctagccaacatggtgaaaccctgtctctattaaaaacacaaaaagttagccagacgtggcaagggagcctgtaatcctagctacttgggaggctgaggcaggagaatcacttgaaccggggaggcagaggttgcagtgagccaagatcgggccactgccctccagcctgggtgacaatggtgaaactctgtctcaaaataaataaataaataaataaataaatatatatatatatatatatatatatatagagagagagagagagagagagagagagagagagagaaggctgtttcatctacattgaaaatctgttgtttagtgaatccatttttatcaatgatcgtgggatcttctggataacttgctgcaggttctacatcaacacttgcacttgcgtgttatggagatggcttctttccctcatgaaccaacttctgctaacttaaacttttcttctgcaacatccttacatttatcaggcttaaaagaattaaaatagttgatgccttgctctagattaggttttggcttaagggaatatcgtggctggtttggtctagaccacttaaactttctttatatcagccattaggctgttttgctttcttgtcatttatgtgttcattgcagtatccctttaatttccttcaataacttttcttttgcattcacaacttggataactgtttggcataagaggactggcttttggtctatctcagcttttgtcatgcctttcttactaagtttaatcatttatatatatattttttaatttaaattgagaggtatgtgactcttcctttcactatacacttagtgaccattgcagggtcatttattggcctaatttcaatattgttgtgcctgaaggaataggggggcccaagaagagggagagagacaggagagtggctggccagtgtagcaatgagaatacatacaacatttataaattaagtttgccatcctatgagtgcagtttgtggaatctcaaattgatctataggttcaatattgtcttcacaaaaatccaagacagctttttgtagaaattacacaattaattctaaattatctatggaaatgcaaaggacaaaggatatccaaagaatctttttaaagaaggacctaattgacagtgcttacactaatttaaaaatgtattataatgctatgacaatcaataaaatatagtaacagtataaaattagaaatataagtaccaccaaatctaaaataaaagttaaaaaagagaaattgaagatgacataaataaatggaatgatatctcgtgttcatggactggaagaattaatattcttaaaatgtctataaagcccaaagcaatctgcagattcaatgcaatctctataaaaattccaatgtcattcttcacagaaatggaaaaaaatcttaaaatttctatggaactataaaagaccttaattagtcaaagcaatattgaccaaaaagaataaagctggagacaccacactacagaatttcaaaatatattgcaaagctatagtaatcagaacagcatggtactggcataaaaacagatacattgaccaatggaatgggctagagatcccagaagcaaaccacacatttaaaaagaaaaggacctgtcttcaataaatggtattgggaaaaattgatatccacatacagaaaatataaatgaacccttagcttgtctcttatacaagaatcaactcaaaataaattaaagattcaaatataaaacttgaaacattaaattaataaaagaaaacataggagaaaagctccatgacattggtttgggcaaagatttaatgactgtgaccccaaaagcaccaggcaacaaaagcaaaaataaacaattgagattggattatattaaaatgcttctgtatagccaaaaataccaatagagagataacttctcagattgaaaaaaaatttgcaaatcatatgctggataaggactaatatccaaaataaacaaggaattcaaactactcaattgccaaaaaaaaaaccctataaaaagtagagaaaggacttgaataaaaatgtctcaaaagaagacatacaagtggccaaaaagtatgtgaggaaatgctcaacatcactaatctttagagaactgcaaattaaaaccataataagacattacctcacacctgttacattggctattatcaaaaggatgaaagataagagctgttgatgaaaatgttgagaaaagtgaaccattatacactcttgttgggaatttaaattagtatagttcttttagaaaacagtatagaggttcctcaaaaaatcaaacacggaattaccatatgatccagcagtctcactgggtatatgctcaaagaaattgaaatcaatatgttaatgagatgtctgcaacctcgtgttcattgcagtattatttgcaatagtcaaaatgtgtccatcaatgaatgaatgggtttaaaaatatggaatatgtacacaatggaatactatttggccttaaaaaattcagaaaattctgtcacaagcaacaacatagatgaacctagagggcattgttaagtgaaatatattattttttattatggcatagctatgcttctgcactgtaccattagtctaggtctttatataatcatttggaactaagtttcattaccctcagtaggcatcattatacccagtccttagtaatgaagcaaagatattcattattgctactcttggtaaacattgcatagaaggaagatcttaaccagtgcaataaggcaagaaaaaatcatacaaataggaaagaaagaagcaaattactcatttttcacagagtgaaaaatatgtctagataattccaaatcatgttcataaaaatgttataaataataagcaaatatattggagacatgaaataaaagttcacatatacaactcaattgtttgcataccggcattatttaagttttctttaaaaacatctttttcagtactaattttgtgcatgacattgtgctaagttttgaaaaaagaggcaggtgtgcctctcaaaaggatttaattatgatactccaagtggtttcagacatatgtatctctgctgtacctgtaaaaaattatgtccccaggagtcccagactataatgacgtcaaaatagttctgaagactgctcccactggcttagccagtatccttaggacccagatatacctgattcttaattctcttttgttcatattctaaacatacacacatacacaaatgcattcaccggggaaatcacttctcttctgagactacagtagagacaataacaaccaagtgttttccattactcaacttcagaatataaaacatccacaacatacacacatgcatgcatgcacgtacacacacatatggacagataatagaaatgttccctcctccacttgcctcccaaggtctcaatgtaggtattatatttctccttcaggaccaagaggatcatatagacataaatatgacttgatccatggataggtcttcagtttcttgaggaactccggtagttttcagggtaagcagatttacttttgtttaagcttttattttaagttcaggcttacatgtgcaggatttggaagtttgttacataagttaatatgtgtcatggaggtttgttgtacagattatttcatcacccaggtattaggcctagtatccattagatatttttcctgattctctccctcctatgggagttatgcacagcaaaagaaactatcaacagagtaaacagacagcctacaggataggagaacatttttgcaaactatgtatctgacaaaggtctaatatccagatctttaaggaacttaaatttagaagaaaaaaacaacctattaaaaagtaggaaagggatatgaacagacacatctcagaagaaaacacgtatgtggccaacaatcatatgagaaaaagctcaacatcactgatcattagggtgagcagatttctgaactgagatttctttattcttattaaagggatgggtgcagattacagtagctgagaaatgaggatgagtaagagagttgtcagaagagttattctcctagcttttaaaatggtgcagcagacaaactggcttgtatgttccattttcactttggataaaatattcacatttcaattactgaaacaatctttgcaggaagtattctatttattccctctggctgtgaaagctaaaagcagcatttctgagagaaaagaattttttctgtgatctgaaaaaaagagagatgacagcctcattccatacttttctgtgttttgtcttcttttcagtgagttgcctctatttcacatgatagtaatgttatttgaattatatctcaattagaaaagtgacaagagttcatttatacagccctaatatttcataaaataaggacataaaaattttataaaagacacatatgaaaataggatagccagttttatacaaccttaaattttcaatagtgacatccctgaagtgacaggtgggtcacctccaatatgtcaaggaggaactataaatatcaatattgatatttttaaattagaaagcctacttagttttcctccaatatccttctatatgggatatgcccccatcacacaacttgctccttttaaaaaattttaatcaacacattccggctgatatagcccacttcttcagacccgtgaagcctattttcatctattctgtggtcataactttgagtttgttcttattttctcacagcacactatcacaccaaatattctctcccttactattcagaagtgttttgttggtccttgttctaccactgcctgttcttctgtgggccttgaaaaacgtattgaacatcttctgtatacaaaagaaacttagttttggagattacatagcctcaaaaatatttgataaaaatattctttattttaagcctcaaaaatatttgattctatggctgaagttttgatatgggtagaatataaagcactatgttctaaagggaatgtcaatttattttgtttaagatgataagcatctttattttcactgaattgactctagagtcaattagactagactgtaatcttaggaaaacattggattctcataagttcttgcatttttaatgatccttcatcctctatatatcatggtacttataaaacaagtggtcttttgctgatattagaaagtggattattattattattatttatttgcctctaagatcattctatgatttcgcttcaagaaaactacagctacaaggggatgattcatatttttctgtatttaggttttctgcaaaccaaaagggtggagtttgggctaaaactagattgaaaatattgtcagtatgtccattaggacagatttaatttgaaaggtaagcccacaggaactaatgaagtctgttaacatttcagaatacaacggagatctctaagatggtgagcacctagaatagagcaaatatttaatcaattcttgaccacagagttgttcagttcatggccaacgttggcctggagaatggactacatgataacaaagaccccagatattcaggtccaaatgtactgactagactcagtttttcctgtcaacacctaatgcttaaggcacacacccagacagtgtatatatcacatattaaacataatagaacaaatatagtcattgatctacaaggaaaacaaaatagccattatgggaaagaagactgatggtcagtcactccttgaaattactcttttttttatttcctgctcacagaggcaatgctataactgctatacaatgaacttccaacagtcattatgtcatttctaaatggcaccagcctaactccagcttcattcatcctaaatggcatccctggtttggaagatgtgcatttgtggatctccttcccactgtgtaccatgtacagcattgctattacagggaacttcggccttatgtacctcatctactgtgatgaggccttacacagacctatgtatgtcttccttgcccttctttccttcacagatgtgctcatgtgcaccagcacccttcccaacactctcttcatattgtggtttaatctcaaggagattgattttaaagcctgcctcgcccagatgttctttgtgcacaccttcacagggatggagtctggggtgctcatgctcatggccctggaccactgtgtggccatctgcttccctctgcgttatgccaccatcctcactaattcagtcattgctaaagctgggttcctcacttttcttaggggtgtgatgcttgttatcccttccactttcctcaccaagcgccttccatactgcaagggcaacgtcataccccacacctactgtgaccacatgtctgtggccaagatatcttgtggtaatgtcagggttaacgccatctatggtttgatagttgccctgctgattgggggctttgatatcctgtgcattacaatctcctacactatgattcttcaagcagttgtgagtctatcatcagcagatgctcgacagaaggccttcagcacctgcactgcccacttctgtgccatagtcctcacctatgttccagccttctttaccttctttacacaccattttgggggacacaccattcctctacacatacatattattatggctaatctctacctactaatgcctcccacaatgaaccctattgtgtatggggtgaaaaccaggcaggtacgagaaagtgtcattaggttctttcttaagggaaaggacaattctcataacttttaaagtcttctgagatgttagaattttcttagccaggttgagatcaccaagtcaatagggagctctttaaatgacaccagaaatctggccacaggaatatttttatgatactcggattactctacatctttggaaagggtaccatcatgttcaaataggtaaataccctctcttatgttattccatgttctttaaagcctttttactatagaggacttcgaagttcactgcatttaatcttcacagacatcatcttctctcctaaatgacagtctacacaaatttgcagcacagtggttggatcactaacactggagtgaaactttttaaaaaatttaaatctctggcaaaacatgagccgtgttcatttatgtctgtcctaacttacttagctcatcattttcctgccaaaatcacttagagtttattctgcttctatcccaagtttgccagctgtatatctatccagtagcaacccatacatatgttaaccagaaaacttctaaagttgtaaattgaagcatgcctgtaatacccagaagctggcaatcacaccaatgtccatcaacattagacaacataaataaataattgtggtctattcaaatatagtattaggtgaaagagataaaaacacatattatatattgtcattgatgtacagttcagaagtaggccaaactaactgagataatgtttaactttgagaatgagaaaccaggtaatgagggggatgcttctgaggtaccaccgttgattagttcttgacctggatggtagttgcagggtgtatcaacttagtgatatttcatgagcctattatttgtaatatctgctctttttgcctgtgtactatgcttcaacatttttatttaaaataatatgtcttgagcacatactctcacctccctaagctgtgagacatttctttcttgcttcctatgaaaactgtctatagtttacaaagtatatatactttcttttctttcagaagtatgttaactttagcataaataatatgtgcatatttatacaaatcataataaaacaacaaagacaacatcatcataaaaaaattaaactttccttttgaaaatgtcctccatctagtccctttttagtgatggcctcttaaaaatattgtttgtgtagcaaagacttggaaccaacccaaatgttcaacaatgatagactggataaagaaaatgtggcacatatacaccatggaatactatgcagccataaaaaaggatgagctcatgtcctttgtagggacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggatagcattaggagatatacctaatgttaaatgacgagttaatgggtgcagcacaccaacatggcacatgtatacatatgtaacaaacctgcacgttgtgcacatgtacctcagaacttaaagtataataaaaaaaatataaaaatatatatatattgtttgtgtatgtgtatgtttttgttgttcttctttttggtggttatgtcttttactccaagctatgtttaaactttaatagattaccaactactctgttacacacagtgaggatttaatttaatacctgtatctatatctgtcacctgccctttccctcaaaatattttatgtgtaaatgtgtatgtatataatcacacacacacatataaaacatcaatgttatatctttaattttctgttacaagataattaccaccttgcattaattctggaaatctttttgatttgtttatagtttggttgcaataacggaaaactaataaatactatttgaattactataattatataaataattttatgagtgttgaatgtgaatgctaatcactttacagcaaagtagggattatattttcttcttcattagttcagtatcatcatcttcattattcttgaagtatgtttccagtatcaatattttttcagagacttctgagaatattttggaccaatcaaaaaaggaaaggagttatagacaattagaaaataacatttataacagagaagaaggaatgatagcaaaaatatccaagaaaagaaatataaagttgtgaaaatctcacaaaaaggacacgaaaaaggcaaggcaatgtaaaacataaaagtaatgatatagatcatctcctcaggatgtcaaatgtctgactttatgattgctattaaaagagaaaactgctaaagcaaagaataatttatcccaaccactatgaaataatttttaagaaccaaattcaaaatgtgatttttaagaaataccaagaaatgccaaaatacctagaagaattgttgatagaagactcaaacccggacatacaactgtgagaatatgtgacctactttttatgcaaatttcaatatacaatgcattattattaactctagtcaccatactgcacattatgtctttataatgtactcatttgataactgtaagcttatattttttggccaccatctcttcatttccctcaccccctaacatgcttctaatctgtttccacccttctctctgtttctatgaatttggctttttaaaaattctacatgtaagtgagataatgaagtatttatctttctatgcctggcttatttcacttagttttccaggttcatccatgttgttataaatggtagaatttctttcttttgaaggttaaataatattctattatatatatatatatgatgttttctttatccattcacctattgacacacttgccaggaggaatacagatagtcctctgctttattttagctcataactgcatctttcttttaattttcttgatagttattttcttgaatgaataattaaagaaaatgatttgaataaactaggttactgataacttgtttgttcatatttaaaaagtggaggctgagaaactacaatgcttatcaaaattactgaattttttttttttttttctggagacggagccttgcttgtcgcccaggctagagtgcaatggtgcagtcttggctcactgcaacctctgcctcccaggttcaagcaattctcctgcctcagccttccgagtagctgggattacaggtgcctgccaccacgccctgctaattttgtatttttagtagatctgaggtttcaccatgttggccaggctggtcctgaattcctgacctcaagccatctgcccgcctccgcctcccaaagtgctggggttacaggtgtgagccaccacagctggccctgaaattactgaatgttaagtagaaaatcttcacgctcagaaaggtagtttatcgggaagttaaatcgtaatttcagcacaccaagaaatccaacgtaacaatgaccctcaattctgactatgggtaaggttggtcccacttacatctacttatggcctgttctattttactttccattatctggcacctatagctgggggagaccagttactcatagagaaccttactgaataaggtggcatatatacttggattgtgttcaagagcatacagtagagttttggtgcaatctttctggggggataaaagtctagcaacataaaagctttaaaattagcatattttttactcaatatctattcaggtctataaattttccaatggaattaatcatgattgtgttgatgttcaccatcaagttgtaacatattggaaattaactcaatgttttaaattttaaaaatacgtaaaggaaagtttatagccataaagtagctttgctgactttgacatattgcagaggagtgaaagagtgaaatattcatgacataatggaaaaaaccgtgataaaatatcctctaaactatgaatattctgaaaactgtgattttcaaaaaaaatttacacatacctggaaataaaaacacacaaaatcctaatagcaagtgtttctgagtatctgaagtatgtactattcagaagtgcctttattgttacttttttctttttcgactaataagcatttactattttagaattaacaataataaataacaacacacttatgatatcacactcatatacatcttttatttatttttaattgccttagacacgaattgccaacttctagtcctaatggtgggatagctgtggcatgggatttgctttcctgactgctcttttttggagcccagctatagtcacagaagttttttccctcacatataggaatctttcccttagggctctgtggtctctggggtctccgaagcccagtttcacactgagactctcgagcatatgagattatgcctgtttcctgtgggaactcggctggactaagcacttctgatccaaactctataagctgaagccagggtcctgccatcacatgcattcctgggccctctccctggcatgaacacctttcacatcacttctcctcaggagctatattgtgggtaagagatttctgccttccagacattattgtgtgacaaagccttgtcttgttctagccagtttgtgtcatcataaggatcaaagacactgacttgcagaaaatgttgttggtgatttcttagtctgagaaaattaggaagagtatgttcattccacattcaaagcagagatagtacttgtaagggatatgtgttcttggtggacaaggtacaggttagatgccctcaaaatctcctttagaatttaaggaactcctctcgttatatttattcttcttcttttttttaatatgtgctgtaatgccagggtcagagaagtggacagtaagaactttactgtctcttaaatcaggaaaaaacaaatagctacaaacttttcccttcaagtcactagcccatcctttcccagtccctcccttttcttaagttgggtcatacaacttggagtcagtcaatacaactccaatttgttgagtattctttttttaagctgggtactgtcctttttcatgggataaaataggtggcagatttggcccatagactaaaagagctcacaggtcagtaaggagacaggataaatataaattgtttgagcactggtgcccaagttatcatcatcataaaaatggagaaaatgtgaaggtagcaaggaggaagaaaggtgaatttcaaataataattctggtttggtttaagagagatggggttgtgcctcaccagtatttagtgtagacagcacaaaattctgtatctttggcaagctattgaacaaagagtcttgattagatagtgattagatactatttaattagcagatgcattataagagtgtgattaaattcaccagttaattcaaatattaagcaaatatattaaacaggtaaatatagacaatcaaatagtactactattacttttttttgtctagtcgtgtggataaatattggagttgatatgcaaatctgctatttatgtgcaaggtaaacctaaaaacaccagagtagagatggagaaagtccttctgctaagtgccaaaggatacattgcctggcacagatacagtcgataatatatatatattttttaattttacaaatgaaatatgttcagtttaatttggagtccatacacttgagacattcagattcaattacagcattttgtgtcattaaaaggttgatttgacatttctgggaaaacattttagagcaacaacagaaaagataaaatagcataagagaatctagaagtctcttttctggatccagctttatcctgacattcctctccagagaatcaaggataggtcgttcagatgcctgataggattttattctgtgtactggttcctgaattccttgaaaaaatactgttccaagccatcactagagaagtatagcgtggaagttaaaaggaagtgaaaaagtaagtctccttggctttcctaacttctaagcagttcctgattcatccacattttctggaggttaggataaagtggtaattcaaaggagcctgttttctgttgtaaacagccagaggcaaccatggatgctacatgtattttgtgtcaaatggctgcccagcgtgggatgaggaggccgcacaggatgcaacagtgataggatcaatcactccacccttcaccagatactggaggcgtggacatctacatcaggtaatggaactcattgtcatcaaggatggacaagcaattgtgattgacacaaggtcgtaagctgcagcatatcttgatgtggtatgttttgttattattatacctcaaatgcgtgcctacattctgttgccttttttaattccccagaaccacaagcaagaataaagaagtcgggtaggctcagggtgagtccgcatagtatttgtaaccaaattaccttctcctttgaaagaaaaaaatataaatcatcccacacaactttcttactatttaccttcacaatgactgcaatgctggacaaggaagaaattttaagaagcaggagcattagaggtcacatgctagaaacatgaagcctcatcttgctacagggaaaacaaagaaataggaaaacaaatacaaaatcaaacaaatgagaaaataaatcactgaactactacatgttagtccacaacttctgcattaattctgtttataagggatttgctttaatggagcatatgtgaaagtctgatctaaggaaacctatgtttcattctgagttaatcactaatagccttgattaagcaagttaaacatcctgtatctaaatcagggtgtttaacggcaatagctcattctggactctggaaaccacagtcttcttcaaagaaagtaacatcctatctcagtgttactaagataagcatcaggcatttaagtctttaatctattttaagttgatttttgtatgtggtatgagataagggtctaatttttttcttctgagtgtggatattcagttttcccaacaccatttattgaagacactgtctttcctgattgtgtgttcttggcacctttgctgaaaattttttggctgtagatatatgggcttttttctgggctttcttttctgtttcatctttcagtcttggtatgttactgagtcaaataatccattttttctacattattcaatttattggtgtataattgttcatagtagtctcttatgaacctttgtatgtctgttgtatcagttgtaatgtctcctttttcattttcattttatttatttgagttttctcttttttcccccctcagttaatctagctaaatgtttgttaattttcattttgtgttttcaggaaagttactcttatttttgtcaatcttttctattatttttctagtctctaatttacttcagctataatattctttactttgcagagatatttgcaaataaatgaaagaaattgagaaaagtcaacatagactttaagtatatgtatctgggggggattagcaagtatttaaacccgaaatgctaaactacattgactatataatgcattgtttaagccaggatacttataagtggttagaaaatggaaagaaataaaacaggaaagaaaagataagacctaaatttccttttattaaatgtcataccaaggaatttgagccctgttctcaaagtaatgggaagacattgaagattattaagcagtggattaaaacatcttcaaaattgtactacaggaaaaatttcacttatgaaatactaaagaggcaatgccaagaaataaatggatgtggctaggtggtctttacgctgaaagtggtgttagaaagaaagagctgatataagaaattttctgatttaaaagttttttttctgaagatagactacagaaaatagatatgttgatgtgacctgggtggagtaacaatttggaccctttgagctgtaaatgaattatatccaagatgaggtggagaaataccagggaagatcataaatacactagtttaggtattgtagtagataatgacaccattatccaaaagacagaacttagaggtaaagtctattttgggcacaggtagagattaaagcaataagtgtagtcttagacataataaatgtaaaattttatggatatttctgatgaaaatagtcgtcatgcatttagaaggactcaacagctgtggcataacttatttatacaagtaattatctgaaaattatcttcatgttggttatacttgaggtcataagagtaaaaacatttcccaaaaagagaataaagtgagagtctagataatatgcttcttgagaattatataaaaagagaagatatggaaagaaaatagataatctcaatgacattgaaggattatagggtacttgagaaaaagaggtttctttcttcttccttcttgtaaccatcaaatcagattgacatttatggtcattagtcctgtattttatatccattttgaatctatacctgcattttgaataatcagcatatctaatccatcagaatattaacctaagagtaaataaatttctgattatttttcagaactctttgaggtaggtatcacctgcttcccatttaagatgagcaactgaggcttggagagtgacataaagcttatcaagtcacacagttagtatagaaaaaactgaaatatgaataatgtgctatttggtagaaataaccataatcttcctattgtgtattggcacacaacattaatttactgaagaaattttggaccgtgcttcacatgctgtcataggatatgtcctctgtgaagccgggatgcacagtaaaaagactgcatgaatgttgaagtcatatatgaatactgtttctgttcctgaatctagttgtgtgacatttaatattattcaatctttctgcgccccagtttctacttttattttgtggtaaaaaaaatacaactttttacttatggctatggaattacatttagactgtttatgaaacttttaaaatgttatctggaatacagtattattcaatacattgtatattttcatagtcacttatgtataattgttggtgccattataaacttaattttattctaaatttgaatttgtatttgcaaggaaaatttgaatgaaatttgtttcataattccttctcttcaggatgaaacttctggaaaaatagaatgcctctatttaattcattatgctggtttccaacaattcatgtgactcctccatcttttattcttaatggaatacctggtctggaaagagtacatgtatggatctccctcccactctgcacaatgtacatcatcttccttgtggggaatcttggtcttgtgtacctcatttattatgaggagtccttacatcatccgatgtattttttttttggccatgctctctccctcattgacctccttacctgcaccaccactctacccaatgcactctgcatcttctggttcagtctcaaagaaattaacttcaatgcttgcttggcccagatgttctttgttcatgggttcacaggtgtggagtctggggtgctcatgctcatggctctagaccgctatgtagccatttgctaccctttgcgttatgctaccacactcaccaaccctatcattgccaaggctgagcttgccaccttcctgaggggtgtattgctgatgattcctttcccattcttggttaagcgtttgcctttctgccaaagcaatattatctcccatacgtactgcgaccacatgtctgtagtaaagctatcttgtgccagcatcaaggtcaatgtaatctatggtctaatggttgctctcctgattggagtgtttgacatttgttgtatatctttgtcttacactttgatcctcaaggcagcgatcagcctctcttcatcagatgctcggcagaaggctttcagcacctgcactgcccatatatctgccatcatcatcacctatgttccagcattcttcactttctttgcccaccgttttgggggacacacaattcccccttctcttcacatcattgtggctaatctttatcttcttcttcccccaactctaaaccctattgtttatggagtaaagacaaaacagatacgcaagagtgtcataaagttcttccagggtgataagggtgcaggttgattcaaggcaacttaattcagatggaagaaagataaatgaaaaataacaaagaataaacttacgtgtgatattttacatttattcatgtgtagtatcatacattttctctctcagtctatgttttctgaaactgttttggggaaatttatagcccattctggatgtatatctcagtgcctttcccttaatttttgtctattgccagtttttaaaaaatgagtttaactcaatttatttaaattgacacataaagttaaatatgtcatatataacataatgttttaaatatatataaaccttacagaatggctaaaactagttcaattcatagaagtaaaaagtagaatggtgtttttttaaaaatcacgtgttatttttctaaattttttaaattgatacataatagttttacacatttgggaggtgcaaatgatattttgatacatgcataaaatgtgtaataattcaatcaaggtaattagaatatccatcacctcaaacatttatcttttctttttattggaaacattcaaattctctttgagccatgttgaaacacgtaataaattattgttaactacagttatccactgtactattgaacactatgtcttattctttttaactgtattttagtacctattaattaacctcttttcatcctctcttcctcccaccattcccagcatctggtaaccaccagtctactctctatctccttgagatccacctttttagctcccacatataaatgagaacaacaatatatatccaaaaaaagaaaaacaatatgttgaagagataccagatacctgcactcccatgtttgttgcaacattgttcacaatagccaagacatgaaatcaacctgtgtccatcaacagagaagtggataaagaaaatgtggcatcataaaaaatgatgaaattctgtaatttgcagcatcatggatgaagctggaaattagcatgttaaatgaaataagccagccacagaaagacaaaagttacattgcccgttttaatcaagtcgttggtatgaattcacacaacttttatctaatatattcatcttggatatattcttaaactttgaaagagtccttaagtgtcttgtctatgttgataatctttcctatagaacattttccagcccagtcagtctttgaagctaaaattaggtttatgaattaattttgagaaatatttttatgtatatattagaatggacagacaagtcttatttacctcaaggcttgcgtacaccagaagtcagtgcaggagctagttggtatatggtatggctttcccagttaaatgtcaaccaattggtgaaatgattgattaaatcattgattcactgattcattcattcatgcttcatttgttagttatttcatttcccatatttctgaatatttttatcaactcagctaaatcttaaaatagaacttatcattacctcttcctggttgtcacacacactatattatcacaacactcttataataagtttatttgtttacacatctgttcattgtatactacaacatgttgtatttgaaagcactaggtatgtatttgtctttgtatttcaggctctgacaaaatgcaactcaaaggtataaataaaacaaatattcattaaatgactagatgaatgagtctacattagttaggccttatgttagatattaaccattagaaaaatataaacattctccttgttacaaagaagcccacagtctagctaaggggtgaaatattaataaaaatgtgttgaattcagtgctatgctaatcatcttaacggaaagcagggtgatagagtcaaatagtctattcaaactaaaaaagaaaaggagtgatcatgttaactggaacattttagtaggagatgaataaaagagtaaatgaaaatttaatctctcaagtaaacatatacattcaattaaactatagtttagaggagctttataagagagtttgcacaagtgctgaaacagcacagaaaatgatcctctaaccttgagagagtaagagagtcacagagagatggtatttaaaccagaatataaatcatgaaaaaaaaaccctatttactagggagacaaagagttctgtttttttcttcaccaaggctatttcttgcctggtggtataattccttccagctaaatgtattccatttataaaaacctttataatgaaatatttatgtacctattatcttaaaaattttgtaaatcagcaaatataacagaagaggtattaaaagcaggtacatatttgctcatggttgaataaaagattatgctgggctgggcacagtggctcatgcctgtaatcccagcactttgggagggcgaggcaggtggatcacctgaggtcaggagttcgagaccagcctgaccaacatgatgaaaccccgtctctactaaaaatacaaaaacttagctgggcatggtggtgggcgcctgcaatcccagttacttgggaggcttaagcaggagaattgcttgaatccaggaagtggaggttgcagtgagccaagattgtgacaccacactccagcctaggcaacaagagtgaaactccttctcaaaaaaaaaaaaaaaagaaaaagaattatgctgataatatacaggtaaaaatagcattcatggatttattgaaaatggcctttagtaaatgtcatattgtaaaacggtctgcaggccaatttactcagggaataaggaatacatataatatacatgttaggcctcaaaaataataaatgcagaatatgactcaaaacacatactgtttttaaatattgatttatttttgatcagtcatttactaattttatgacattttctctattgaataaaatagcctattaagaatattcataccttaatacataaagctcacaactaccggatgtgtaaaaaagtcttgaatatactttctccactataatctctaagttgtatatctctttcctggctcactgctcattagtgatttatcacctgttccctccacttttacctctggaatatctaatgcaacagttgttgaggtgttatccatggattgttgagggcttcatgttcatttgtgtagacatatgaagtcacaacaattttcatagtaatactaaggcattatttgcctttttcagtttcattctcttactaatatataaaaaatacaccaatatatttacacgatttatgtaaccactttcctattcttagacatctgtggatttttattttacaagaagtgatgcaacaaatatatatgtagagaacattttaaatacaactttttcttttttgtgatagaagctacataacataaaattaacctttctaaccattttaaaaatatacagttgacacttaggttgcttccaaatcttagctgttgtaaacggtgctgcaacaaacataagagtgcagatatcccttcaatatatactgatttcctttcttttgatcatcaatagatgaatggataaataaaataaaatgtgttacatatgcacagtgggatactattctaccataaaaaaaaagtgatactgtcatttgcaacaacatagatggaactggagatcattatgttaagtgatgtaagcccggcacagaaagacaaacatctcatattcttacttattagtgggatctaaaatcaaagcaattgaactcatggacacagtagaaggacggttaccagaggctggcaagtgtagtgaaggtctgggcatgggaggtggagacagtacaaaaaatagttagaaagaatgaattaaaaaatagaaagaatgggtacaaaaatagaaagaatgaataaaagttactatttgatagcacaacacagtgactattatcaataataattgtacattttttaataacttaaatagtgaattggattgtcactcaaaggataaatacttgaaggaatggataccccattctccatgatgtgcttatctcacactgcatgtctagagcaaaacatctcatttatcaaataataaatacctactatgcatccacaaaatttaaaaataataaaattaagtgtacaattgagtggctttaaatatggttacaatgctgtgcaaccatcacctgtatgtaagcccagaatactttcatcatctcaaaaggaaactccgtaaccattagtcagtctgtccttatcatcctgtcccccttggctctgacagcaattcatttgctttctgtttctatggactattgtaggtattcatataaatggaatcacacaagagatgggcaactgagtctaactttttcacttaatatgttttcaatagttatatatgttgcaacatgtaccatacttcacttcttctggtgacagaataataattccataataattccttttatgggtatactttattttgcttatcctttcagcaatcgatggatatatacgtcatttctactttttgattaataatgttgtaaaaaatattcctggaaaaatcctagggaaaacaaaggataaccccaaaaggtaaaataaataaataagtaaataaggtggcaaaccaaacaaatattttggtttgggaggtaaaggttaattatttaatctctaccacaagttgatcctatttcacagggctaggatatatatatatatataaaatatatatatataaaatatatttatatacacacacatatacatacatacacatacatacatacatatgcaataaaaaagtacaaaggcaaaactatatacaatatatgcacaaagagtttcatagaaatagaaactaaacatactaaaaaccttccccaaaattttttgaggaaatattaaagtcaaagtagaaaccaaagaaagtaagtactgggtagagacaactttcgataaacaatagatgaaatgcatgacaccatgcaattaaagctgattgcagcactgttcagaatagccaagatttggaagcaacctgtgtccatcaacagatgaatggataaagaaaatttggtacatatacacggtggagtactattcagccacagtaaagaatgagatcctgtcatttgcaacaacagggatggaactggagattattatgtgaagtaaaataccataataattatgttcaggcaagaaagacaaacatcacatgttctcacttatttgtggtatctaaaaaccaaaacaattgaactcatgatcatagagaatagaaggataattactagaggccgggaagggtagtgggttggggtgggagctggcggggaaggtggtgatggttaatgagtacaaaaaaaaaagttataaagaatgaataagacctagtatttgatagcacaacagggtgactatagtcaataataacttaattgtacatttaagaatgagtagtataattagattgtttgtaacaccaaagataaatgcttgtaggaatggataacccatcctccatgatgtgattattatgcattgcatgcctgtataaaaacatctcatataccccataaatatatacatgtaatatgtacccacaaaaaattgaaaattaaaaaaaaatcaaactgattgaaccaaattgtttcattttcctgtctgacacagtttccctcaagcaaaataatggaaaacactgaagttatttttctcacattattagtacacaatgaaaattttaaaatggggaatccacttacattaacacaacttcttggctgatcttcaattttcgacttagcaacactggtatggatttacacaaataatttcaaggctaagaaaagctttgtaattagtattctggttataagaaaaatatgtgcttacaaaatgagaaagtgtttccttgtataacaaaattatcaattttctttctgtgaagcttgtaaatttgttcttcatgtttgtgtattctatttttcaaatttcctttacaatttattattaaagaaactaaattaataatttatacacatacatacataattgtatagattactgtgaaaataagctagattttctaatgtagtttgataaatatttgactaatatatgccaagttctcataaatatttgaaaaatattgaattattgcttgcttttcctgatcgattcatttaagcagtcaactcttaactctatatgtctgtaacagaagcaagtagagaaattagagaacgtaaagatacctctaggttgaaaataaaaaatatatctttaggatgagttatgctgtctttatctcacattgcatatttatcttatgttacatatataatatctcacattatatatttaatatatattacattatatctcatatatttaatataccttatattaatatatattaaaactgtaactataaaagggaaacacataaatatcctatttatgtctcttgtgtttcctttttatatagttttaattactaaaactggctttattgttacatgagaagtttagttctcatctcaattacatttataagcatctcagttaaagatcttgctgatacaaaataatatagcactaagcacaagttatataatactttctccaaaacaaattaaaaacgctttttttaaagttagcaaaaatttattttactttgttaattctctcttcttttaatacagcagctacattttaattttatcttacatgccgctttctgtatttctctaatttgtgcttcccgagagtcaaagggaaagagatttcgattgagaaagatgtctgtttgaactgtactataaattgcctctgagaatgatatttatacttgctggaaactcagctgggcaatgtgactgctgtggcaatgtaaatttacacaaatctatctaattgctggtgatgaaagaaagataattcagctttatattttatgaaaaagggaaattataataccttctagtccccaatacgctgagttcccgattatcaggatttgaagctgagggccacaactttttttaaaaagtgatgagtctcatcaagaaatataagcttataaaatgcttttaatactatattactttataattctgcaagaataatagatttgtattatgctgtgagtgagtaggtctattaagtgataacattaaaaacaaataccaccatttataaagtatgattttgatatcatcggttgtgcattttcaccccaaactctgtaaatagtaactttgtttcctcacttgaccatgctcagtctttacagaccatgctcttttctcaaaatgactgtaggttcatccaagtatgtttgctgtccaaaatcaatgaaacacagtcacaactatgtctgtctaggaataaagccagttaattagattcttattctaaggaacaagaggagggcaggtaagaacttgattatggaagaattctgaccataatcaagaactgttttctattttttctccatgttgtcgggtggttcatacctgactttcatcatttccaatgattcctgtttgctttgtttataaatattcaaaatcatcataaaaatttcgctgaatgaaaacctgaaaattggggaaataaacattctgcaaaacaaatgtctgcaacacttctaccttcaaactaagtggatgaaatcaagtctgaatttctgagaataataatagtatacactcaaagattctgtacactttggcaaaacatctctccaatttatctactatgaactacaacaagaaaaatcctgtcactacccctgtctcctttttatgtcctttaatacctaatttccagatgccaatagaatgagctgaatgcagtttggcccagatgttcagaatcttggtcaaagaacacatgagaatcctacaatatatgtacatgtactccccccaacattaaaatcccttgatacctttactactgatatgagcctttaaagaaaattatgtgttatatgtcccaaggggatatttcatataattagggtcacagtgttggaattaagacaacgctcacaggagatgaaagggtggaaacactccatgctcatcacctatatgatgcctcataagtaactagtgaatactttcctatgaatgtatctgtacatgtgcttatgtgtggccatgtatatgtggggggaagcgagaaagaacacaggatgtttttattttaaaaattatgttattaataagattgcagagttgtttctttttgcttaaggccttgtggcatacaaattggaagcaagcacagaatgtgttaattgctcacacagacaactttgcatcttcctttttttatgttttcatgtattaagtaacatcattgagtgcttcatactctcagagttagtctaggaactttgaaaaaagcatcagaaaacatgggccttggttttcaagcaatttatttccaaggaagattggtgatgaatattatggaattgtaaaaattaatcaaaagttcagacttattacatataaatattaaactagcaataaatagatgccttaattttgagataataatagtgatgcaaataaacgcaataataaaagacaataattaatctaattttatgtatttttatttagaagaaaaatgtttgtttttattaagtgtaaaaataaaaatgaggacatcacagagataattagaacctaattctataatgtagaggtaacttctgatactttttcttttatatacaatttctatatatacttttgacaaacgtttggataacatcaaattttaaacaaaaattctatcattttcagttaatgtttatattaagcacattcaaaaaaggattgttcagtattatgattaaataaaggcacattatgtgttttacacacttccttaagtattttcctgttctcagacatctatgttcttttaatttacagaaagttatataacaaatatacatgtagagaataatttttgcagttttttatattgttttatattgaatgtaaattagtacgacctctatggaaaacagtacggaaatattcaagaaactaaaactagaactaccattccatccagcaatgccaatcctaggtatctacccaaaagaagataattgcatttaaaataattacacttaaaaatattggcactagtatgtttatcacagggaaagatacggaatcaacctgtgtccatcaacagatgactggataaaaaaaatgtggtatgatatacaatggaatactcctcagtcaagaaaacaaatgaaataatgttttttgcagcaacgtgcatagattatgaggccattattttaagtgaaatatctcagaaacagaaaagcaaataccacatgttctcacttttaagtgggaactacctaatgtgtacacataggcatagagtgtgaaatagataaatattggagatttgggggatgggcagatggaaggggaatgaggaatgagaaattccttagtaggtacaatatacactatgctggtggtacccactatggtgggtacactacaagcccagacttcaccacagccaggctatacatggatatacatccatgtatcaaaaagcagttgtaccccttaattttatataaaatgaaaaaagaaaacgtacaattgggtgactttcactacattcattatgctgtgcaaccattgccactatctaatttcacaatatttccattacctcaaaaggaaacttcataactattagttagtctctcattattgcctggagtctccattccctactaacaactaatttgctttttttttctatagacttaacctat

SEQ ID NO: 1781 - DNA, 90137 bp, Homo sapiens
  POLD3 gene - 73981277 - 74031413 of chr11; NCBI Entrez Gene ID: 10714; Build 35; sequence includes 20,000 bases upstream of initiation codon and 20,000 bases downstream of termination codon of the gene
tgaacttctataaaatattgtccagaggagtggcattgtttaatgattagtactgtatgccaatagtacctcgaactcaacacatctggtaattatctccattttccagatgaggaaactgaagcctagagagcttagggggcttgcacatgatcatacagccagaatctgaacagagatctgtgtgtgcagtgctcttcagcaacttgattctttattgcattgttctataatccgttttcctgagcaggtcttgttttcccaactaaaattccttaaggacttttttttttttttttttttgagatggactctcactctgttgcctaggctggagtgcagtggcgcgatcttggctcactgcaacctccatctcccgggttcaagcaatttttctacctcagccgcccgagtagctgggactataggcacgtgccaccaacgcctggctaatttttgtgtttttagtagagacagggttttgccatattggccaggctagtcttaaactcctgacctcatgatccgcctgccttggcctcccaaagtgctgggattacaggtgtgagccactgcacccggcccttaaggacgtattataggtcttttatttcttttgtggccacggtggtggctagcattatactaaacacatggtaggcactcactaaagacttttcaaatgactgaatcactcattcatttatttattccctttttaagcaaacatttattgaacaccaattattacataggtcctggacactgagaatacagaaataaataacacaatattccttttcttaagaaactcgcctagttaaaaaaaaaaaattcaacctgacactgtaatctagcatgatagaacctcaaagggttatgacagcaaaggaaaggagccctaaactagcctggcagagaagatacctgccttctttatggctgaggacactgaggaggatacttctgaagagagcacagcagatgcaaagacttgtgggaaataacacggtatgtacctggacttatcagcagtctgtgttgctggagcataggtaagaagcagctaggggtgagaggtgaagttgaggtggtaagaagctcaaacttgatctctttttttgggacagggtcttgctctgtcacctaggctggagtacagtggcgtggtcacagcttactgaagcctcaaattcctgggtttaagtgaacctcccacctcagcctcccctgtagctgggaccacaggcacacgctactatgcctgactcatttctttattttttgtagagatggggtatgactatgttgcccaggctggtctaaaattcctgggctcaagtgatcctgccacttcagtctctcaaagtgttggtattacaggtattagccacagcacccggcctcaaacttgatcttaaaagcactgagagggtcaggcgcggtggctcacgcctgtaattccaacactttgggaggctgaggcgggaggatcacaagatcaggagtttgagaccagcctggccaatatggtgaaaaccggtctctaataaaaacatacaaaaaaaaaattagccaggggtggtggcgggcacctgtagtcccagctacccaggtggctgaggtagaagaatcgcttgaacccaggaagcagaggttgaatgagccgagattgcaccactccactccagcctgagtgacagagtgagactccgtctcaaaacaaacaaacaaacaaacaaaaaaaaggccgggcactgtggctcacgcctgtaatcccagcactttgggaggccgaggcaggtggatcacgaggtcaagagattgagaccatcctggccaaacaacatggtgaaaccccatctctactaaaaatacaaaaattagctgggtgtagtggtgcacacctgtagtcccagctactcgggaggctgagtcaggagaatcgcttgaacctgggaggcagaggttgcagtgagccgagattgctccactgactccagcccaagcgacagagtgagactccatctcaaacaataaaatgaaataaaataaagcactgagatgcaccactaggtaataaaaacacattcagaccaagactcgtatgcaaattttttagtaccaaaactggaacttatccaacacccatcatctggtcagtaaatgaataaaatatggtacactcatacaataaaatactactcagcaataaaaagtaatcaactactgatatttgcactaacatgaaagacgatacatttgtttgcttggactgccataacaaagtaccacagactaggtgacttaatacaaattttggccaggtgtggtggctcacgtctgtaatcccagcacttttggaggctgaggcgggcagatcacttgaggtcaggagtttgagagcaggctggccaacattagcgaaaccctgtctctactaaaatacaaaaattcgccaggtataatggtgggcgcctatagtcccagctactggggaggctgaggcaggagaattgcttgaactggggaggcggaggttgcagtgagctgagtttgtgccactgcactccagcactccagcctgggcaacagagtgagactccatctcaaaaaacaaacaaacaaacaaacaaacaaatttattttctcacagttctgaaggctagaaatcaaggtgttgtcagagttgatttcttctgaagcctctctttttggcttgcagaaggccatcttctccctatgtcttcacatggttttccctctgtacatgtacaagtcctcatctgttcttataaggacacctgtcattagattaagacccactctaatgccctaattttaacttaagtaccattttaaagactgtctccaaatacagttacattctgaggtcctggaggttaggactttgaaatatgaatttgggagggacaaaattcagcccaaaacagaagtcatacacaaaaactacacgttatatggttccatctgcattgtttccgtttttactttttaaattttgttgttgttgttgttgttacaggatcttgctctgttgcccaggattgaatgcattggcacagtcacggctcactgcagcctcgacctcccaggctcaagtgatccgcccacctcagtctcctgtgtatatcagactacaggcatgcaccaccatgcccagctaatttttttttgtagagatggggtcttgccacactgtccaggctggtctcgaactcctgagctcaggctatcctcctgcctcagcctcccagaagtgctgggattacaggcatgagccatcatgcccggcttaattttttaaatttaatttttaaattttttataaagagagggtctcactatgttacgcaagctggtcttgaactccaggagctatcctcccactttggcctcccaaagcactgggattacaggtatgagccaccatgcccagcacgctgcatgaaatttttagaacagacaaaattatagagacagcaggtcagtggttgcttagggctaaggggtgaggtagggattgactgtataagtggagaatataaggcacaaggaaactttggggatgatggaagtgttctaagattggatttgggtgatggttacgcaactataaatttactaaaattcacctgactgtatacttaaaatgggtaaattttatggtatgtaaattatttatcaatcaagttattaaaataaagcagtagcggggccatggaaggaattttacctgaggttggggggtggtggtcaaggtcagtttagcatttagaaccatctttttttttgagatggagtctcgctgtgtcgcccaggctggagtgtagtgacgtgatctcggctcaccgcaatgttcgtctcccaggctcaagccattctcctgcctcagcctcccaagtagctggaattacaggcatgtgccaccatgcctagctaatttttgtatttttagtagagatggagtttcgccatgttggtgaggctggtcttgaactcttgacctcaagtgatccgcccaccttggcctcccaaagtgctagaattacaggcgtgagccaccgcgcctggcccagaaccatatttctagtggtgagtatggagaacagactggaagaggtggaaatggagacagaaagaccagtggggaggctgaaagatggccgggcctgtgctcagcgaggggcagtaaggatgggagtagacttggcacctgctgttggacaggtgatctgtgagaaatgtggttcccggggatggtcacagagggagaccagcttcctggaggaggaaatacctcgtgaaagtgcccagcagaccggacgcggtggctcatacctgtaatcctagcattttgggaggccgaggcaggtggatcacctgaggtcaggagttcgagaccagcctggccaacatggcaaaaccctgtctctactaaaaatacaaaaaattagctgggcgtggtggtggtgcacacttataatcccaactactcgggggcctgaggcaggagaattgcttgaacccaggcggcggaggttgcagtgagctgagatcacgccgcttcactccagcctgggctaaagagcgagactctgtatcaaaaaaaaaaaaaaaaagaaagaaagtgcccagcagatggacgttccctttgtctggcctaatggggttctcaaaggccaagatgtatcgacagaggcagaggatatatttctgggtatgaatcagctctgagaacaatggggggtgggggcagctcatcagaaacccaactctccaggatgaaaaatgaaggcattccttactgacctgctatcccatacttcccagcctcttctagccacaccacagtccggtggctcatttatgtcctggccatgtctgtgccaggctccagctggaacagggaccagtgatgaattagacatgggcctggccttcaggagctcacagcaaactcagtgagagagatgtgtaaggtatggatgcctctttaatttttttagcaacaggtgccaaagtatcctgagaagaaattaggataatctatgaaaaactaccctatagcctcttggaacttgggtagagaaagggtgggattgtgttgcatgagacaagggaggtttacacacacatatacacacacacacacgcacgcacacatacacatgcatgcacacacattcacacacacatgcatgcacacacgcaacacatgcatgcacacacacacgcatgcacacacatgcatgcatgcacacacacacacacacacacatatatgcatgcacacatgtgttcctaacaaggagaagggggaagactaaaataccctgggctgggaagctggctgaaacaagggaattttggagaggagagacctcaggtgggaaatcttaggtgtaaattgtgggaactgtgcagtgtaccccttcccccacactcctcacatccttagtacactgcccaaatccccaaatgcctgatgggattgcatatttcatggaaatcaggagctgaaacagaatcttgcccagccagatgagaagcagcagcaccatctggactgtgtttaatcagcaggaggccatgagacaaatgccaggaaggaggctctcaagcttccagacataaaggaatggagcagagtcaagggcagtatttcaggctgcagcagaagcaggaagcgaagacatgtggctgtgatagcaggtgtgtgctgttggatgatgctggcgctactgcagtttgacattgctgaagaggaaggtggaagaaggaccagaccctgaagagccttgaacgctcccgtcttctctactaagaaactgagacttgccggacacggtggctcacacctgtaatcccagcactttgggaggctgaagtgggcagatcatttgaggtcaggagtttgagaccagcctgacccacacgatgaaaccctatctctactaaaaatacaaaaaaaattagccaggcatggtgtcatgcacctatagtcccagctactcagaaggctgagggaggagactcccttgaacctgggaggtggaggttgcagtgagttgagatcgtgccactgcagtccagcctgggtgacagagtgagactccattaaggaaggaaggagggaaggagggagggaggcagggagggagggagggagggagggaaggaatgaaggaaggaatgaatgaaggaaggaaggaaggaaggaaggagagagagagagagagactttattctaaaatcaacagagaaccaccaaagggttttaagcagggagtaacatcatcagatctgtgtttcagaaacatcatcctggccaggtgcagtggctcacacctgtaatcccagcactttgggaggccgaggcaggtggatcatgaggtcaagagatcgaaaccatcttggcccacatggtgaaactccgtctctattaaaaatataaaaattagctgggtgtggttgtgggcacctgtagccccagctaatcgggaggcttaggcaggagaatcgcttgaacccaggaggcagaggttgcagtgagccgagatcgcaccactgcactccagcctggcgacagagcgagaatctgtctcaaaaaaaaaaaaaaaaaaagaaaagaaaagaaacatcatcctagaacttgtgttaaagatgaaccagggccagggagggcggattggaggagagatgaagctagaaaagatgaggacgagcaggcatttcctttattagtagaaaaacaacttaaaaagaaaagactgatgataggagggcctgaaatagggcaggtacagggacagcagaggggtggtggaggcatcatagagcaagggaaaatgagggaagttagttggggaagtccactatctgattttgccttaagaagaaaatattgaaaggtaagatactttaaattggtcaaccccaaacatatggaatgtttactaaagtactgtgtgtcaaggttgtacgtaggaacacgtgaagcctccctgtggggtctagcagcagggctctttgcagccctcaagcctgtttaggacctgggctcgttgcctctctgtcctcatttctgatcattgggtctttgaaggaagctggatttccccattagcttatctataatgctcacttgataacagacaatagtcattgcagtggtgcaaggaaaagtagacaacaccttccacaaacaatattctgtaactcaacaaaaaggactatagagcagaacaatatttaattcaatttcatccacccatccatctattcaccaggcattcagtttccagccaataaatatttgctaagggcctgtccattccagttttagccaagcagggtgctgggaaccagggatgaaaaggcctttgaagaattccatgtcccctcctgcagattccagccttcagttcctccagtcaggcctccctgactgacaacactctagacggagcagaccccacaatgcctggcatgccttttcctaacacaaacgtccaccaccacctcctagccctgtggcttagacagacatgctatgaagctcacgaccatcctcaactccttccacctctccatttccatgtatttaattggccagagttgtcctcaccttctatcttcagttcttctcactcttcattccttaaattactgaactctggcttttgtgcctgtcactcttctagctgacggagaccaaattcaatgcattccttttttttttttttcctgcgatggagtctcgctctttagcccaggctggagtgaagtggcatgatctcggctcactgtaacctccgcctcctgggttcaagcaattctcctgcctcagcctcccgagtagttgggattataggtgcccaccgccacactcagctaatatttgtttttttgtttgtttgtttgtttgtttttgagacggagtcttgccctgttgcccaggatgtagtgcaatggcgcaatctcggttcactgcaacctccgcctcccggttcaagcaattctcctgcctcagcctcccgaatagctgggattacaggcgcccgccaccacacccagctaatttttgtatttttactagagacgcgttttcaccatgttggccaggatggtctcgaactcctgacttcgtgatctacttgcctcagcctcccaaagtgctgagattgcaggcgtgagccactgctcccagcctaatttttgtatttttagtagagaggggtttcaccatgttgctcaggctgatcttgaactcctgacctcaggtgatccacttgcctcggcttcccaaagtgctgggattacaggcataagccaccgcatctggccaacatggtcttttaactgtttgttaacttatctgtctccaacctgggccatatgtctcttgtatactattgtatctcatatatatagtgaagtctaagaagaaactcagtgaacaagtgaggaatgaatgaatgagcacttgtccaagaggacctgtccacgggctgcttagtatcctgaaaaaattttgataatctgaaattttaaaaaaacctaaaactgaaataagttgagcaaattggactggaccatttaggaattacaaaatggggaactgttgagaaaatctgtagttagtcatgggccaaaagctggaagtggtagttgagatgagccatggcaacaatggctgtgtttacactaaaattatgaggaaacaaaaactgtggttaagcagagaagaaaacagagcagtcatacagaaagaagcaattaggtcaaaagacaatgaggcaaagagagcagctcactccatccagactgtgtctggaacagcccttgcccttctttacctgacatgaaagctgagaccatgtgacagctcctcaggaagcctccctgaccagcagtgtttgggggcagaaaccaatgttctctgaaaaaatgatcatatgcttctttctagccctgaatgccaaccccacctgacacacattgtaagaattcagaggccaggtgcggtggctcacgcctataatcctagcactttgggaggccaaggtgggcgatcaccaggtcaggagttcgagaccagcctggccaatatggtgaaacaccagctctactaaaaatacaaaaattagcccggcatagtggcgggcgcctgtaatcccagctactcgggaggctgaggcaggataattgcttgaacccaggaggcggaggttgcagtgagccaagatcacgacactgcactccagcctgggtgacagagggagactctgtttcacaacaaacaaaaaaacaaaaaattcagaaatgatgtgcttaagacaaaattgcccatagccagtttccagttatcttcacttttagcatcactactccaagcactctcccagcccccaagggaagggagaaaggaaaaaatttatacaaagcatatgcaaggtggggatggaaggtcctcctgctctttttctgaatgtctgaggcagcaaaggtagagatgtgaacctctggtgagcgagctgaggaataaacaggctgggatgtgagtgtggctgggagcatgacggggtggtataggtatagaacaggaaaaccagtatcacagtgtcctcttggctcacccacttagttttggtaactgagggactttacattgatttttatagcactgataaggtgttttagaacaagcacctgcaggcttatctcactgtccttgagctcctacgtcaccagctgtcatgagcgtgatgtgtcctggcctggcctggcctgggtagctatacattccacaagacagtctatgtaagatacacatgttctcataaaagtttatgacaactttaaaaaatgcttttatttttgagatggggtcttgctttgtcacccaagctggagtgcagtggcatgatcatagctcactgcagccttgacgtcctgggctcaagtgatcctcctgcctcagcctcccgagtagctaggactacaggcacaagccaccacacctggctatttttttctttttctttttttgtagagatggggttgccctgtgttgcctaggctggtctcaaactcctggactcatgcgatcctcccacctcagcctcccaaagtgttgggattacaggcatgagccaccatgcctggcctaaacaactttttgaaaaagaagaaatacaggcttgtgatgtattgttaaaagttgtaacaaagacagcactctggccacgtgtggtggtttacgcctgtaatcccagaactctgggaggacaaggtgggtggatcacttgaggccgggagtttgagacaagcctggccaacatggtgaaaccctgtctctaccaaaaatacaaaaattatccaggcgtggtggtacacacttgttgttccagctactcaggaggttgagttatgagaattgcttgaacccaggaggtagaggttgcagtgacccaagattgcaccactgtactccagcctggcaaaaaaaaagacagcactctgatttcatttcttatatattgcaccaaatgaaaggaaggattacgtggtatatatccctggtatccaggtccaaagtctttccctgatttcctctgatctttgggctaggtgagctgcctcctccaggttcttgtggcacactgtgatttcctcacactgtattgctctttaccctatacagactgtaaactcccagagatgaagaccatgctgtgtcccgattaatcacatagagcctggtatacaagaggcctgtagcaatgtttgttgaatgaatgaatgaatgaatgaatgagtgatctaattactaaatacatctgtgtcaacaagaaatatgttggtgttaagattacttctttttttgttttgtgtttgatacagggtctcactgtgttgcccaggctggagtgcagtggcaggatcttggctcactgcaacctccacctgctgggttcaagcgatcctccctcctcagcctcccaagtagctgggattacaagagtgagccaccacacctggctaatgtttgtattttttagtagagacagggttttgccatgttgtccaggctggtcttaaactcctggcctcaagtgatcctcctgccttggcttccccaagtgctgggattataggcataaaccaccgagcctggtcttaagattactttaatcttatactccttagttgacctgttaccctgcttggaaaacgttacccccaataaacctgtagtatccctgaaggctagccaactgatagggttcctaagttgcccccaagggcttcctttcctgtccagaggcctggcctccttccctcctctgagtttggggatcctgcctgcatataggttgattgctcatcaccctgccccaatattgagccctgtctagatttcccactccatgccctgtcagaatcattagactgtctgatgcaattatttctgggatgaagcggggatgacgaagaagacagaggagggtcagccttctacttctgacacctatcttaggttcttttttgaggcatggaggctgaggtggttcggtcctatggttcccactgctggtggcacctgacaccaacatccccaacagttttgtctgacctctcttttcgctagaaaatgctttggctgattgattattctggcttctggagaactgcttttgttctcaacatgaggcacatatggtaagcctcatccttaaggaataaggagtgagttgttgtttttttttttttttaaagtgacatttaagatgttgtaagtaggaatggtggtgctagtcctttctggagattgccttttacattttattttttttgaaatggagtcttactctgttgcccagaggggagtgcaatggcaggatttaggctcactgcagcctccgcctcccgggttcaagcgattctcctgcctcagcttcccgagtagctgggattataggcgcctgccaccacacccagctaatttttgtatttttagtagagacagggtttctccatgttggtcaggctggtctcaaactcccgacctcaggcgatccgcccacctcggcctcccaaagtgctgggattataggcatgagccacctcgctcagccgccttttacattttaaatagggaaacattacagagaactggaataaaaagagttaatttgacattgctaaatgctccatttttttcaaaatgaaaatatgttcattcttttctgattataaaaatgatacagactcttggccaggcgcgatggctcacgcctataatcccagcactttgggaggctgaggtgggcggattgcctgaggtcgggagttcgagaccagcctgaccaacatggagaaaccctgtctctactaaaaatacaaaattagctgggtgtagtggcacatgcctgtaatcccagctactcaggaggctgaggcaggagaatcacttgaacccgggaggcggaggttgcggtaagccgagatcgtgccattgcattccagcctgggcaacaagagtgaaactccatctcaaaaaaataaataaataaaaatgatatggactcttgttaaaatttccaaacacatataagaaaaaatagatataaagaagagaacaaaaatcagccaaatgctatcgtgtaaagataaccacggtgttgagaacatgggctttgggcatacctgggctggaaacacatctttaccacttactacctatgtggtttgggataagttacttaatttctctgagctccagtttcttcatctgtacaatagggataataatttaagctaagtgacatctataaaatacagataatagtaggtaagtaataatacttactttattggtcgttccaaagattaaatgaaaatattcaagtaaaaggcctagcatcgtgcctacatatgcagtgaatggtaattcatagtgaacactctgaggtctccttttttctcagtcctatatttttccccttaaatctcactgcttttagtgtaattacacgtaagtcaggacaggcgccgtggctcacgcctgtaatcccagcactttggaggccgaggcagatggatcacctgaggtcaggagttcaagaccagcctggacaacatggtgaaaccccatctctactaaaaatataaaaattagccaggcatggtggcaggtgcctgtaatcccagctactcaggaggccgaggcaggaggactgcctgagcccaggaggcggaggttgcagctagccaagatcatgccactgcactccagcctgggcaagagagtgagactctgtctcaaaacaccaaccaaccaaacaaacaaacaaaaaaactaaatcagtaaacatttattaagaagctattagacactggtggtggtgttgtcattattattattatattaggatgaggctagttgtaaagtgctacttagttatttgtttaagcaaaccttgtcttagaacttacatggaattgttttctactaactcttcccattaacaacataaaattgatctcaaatttgggtccttttttggtgaagggataattgaatctaacaggattggctgaggattaaataagccactctaggcaaggtactcaaaacacggtatgtgctcaataaatgatagttattatcatccaagcaatgtatacaacctaaaagactcttcatctgggattcatggcagtaaaagtacagaggagttctcttttctggtttacttttgaccctaaaatgaagccttcaggcattatctagataaaatactaatctcctggacacagtcctaggtttcttcactggcatttgctagctgtagttcccttctaaatctaatcaaaggtctatactcccctcaaacttcccttacctccaacacctgactcaaaaactttcaagattaacttttatttgcctggactctatgttgtcatatgatgtgatactcaacatatccaatttgttacttggtttctactgaaagtaattctcacttgactgatgtgcacaggaatcccaaaattctgcaataaaatgtgttagagttcactgtacttattattggttttatatgtacagttgtaaactaataatgagatggcaaaacacagtgtttaagatcatggatgctgtagccagattgcctgggttatacttctagctgtgttgctttgtgaccttgggcaagttatttaacctctctgtgacagagtttacttttctgaataaagggaataataacatgctttactttctagggttgttacagagattagatgggttaatatttgtaaagcacttggaatggagcctgtcatgtagtcagtggtatataagtgtttgttatataataatagttgccatttatggagcacttaattatctccaaggcacagaacatgttactttcaaccctctcaatcatgcaaggtagataaattatttacagtgatgcacgagagctggttgatgcacttgcttatgagagctgaatgttaaattttcagaaagtttgcaagtcagttaaacagagccattactgaaaattaaattatataaatgtacaatcaaattatattaaacacaagacaatattcaaatttcatcacttcctaagtgttttactactatctatgctctttttcatttgtgtttttcttttatagagagacaggtctcactatgtttcctaagctggactcgaactcctgggatcaagggatgctcctgtctttgcctcccaaagtactgagattacagatgtgagtcactgtgcctggcctatctatgctcttgaggttatttatgtttattgtgtctgtatgatggaaataatggtgtgatactgtgcatctcttcctaactctgcattctatggcatcaatatctgtagcttgaattctgctatgtggagtatttataccacagaagtgcaaccacttcaaatcagggctttttttatttagcaagttggttattacacatttatctgtacatcgctggatattattatctctcttcttttaagatgataaaagaagttaaatgatttgcctaaagccacactgctagtaagtggtaaagctggaattcaggcccagatgtttgtttgtttgtttgtttgctttcttgcttctcacaagaaacattgtttccaaagcccatatgcttttcattcaattacgctccaaattggaaaaggaaaaatcaaactggataggccttagacacagaaacagaaaagctatctcttctcttccccctccagctctcctgcccttaacccaacccccagcctacccaatcctgtgcagagctgtagtcattcctttctagtcccattatcccaacccagacttggagatacctttcattatttatcttgatttgataatccaattactgccttgctttgcaccacttttgcccattatcccttcttcccagaatctcctttctattgtccaaggttaagattaaacccattctttctaatacctctacctattttctattttcctagtttgaaaagacttgacactgtagttaagattcctcaaataatttccttaaacttttgattcacgcaaacatccatatagaaaactatacatatcaaaagtatatacctcaaatcattttcacaaactcaacacaccatgcaaccagcaccaagatcaagaatattaccttcatctcaaaagcctcctcatactcccttccagtttctaccctcccaagggtaaccactaatccagctaagtcattcaaccctaatattggcaggtccattgggttgggctgggcactctaaacagtgtggttgatataggagttaagaagaaatcacttaggcagatagtaagggtatagaagtccatggtaaggcttttctttttcatgaaaagcagccccaaatcattttctaacaaagaccagcctgtaaagttgagcttcagacatagacaagcaagctgggagcttgcacgggtgaatgtgggcaggaactagggactagacatgttcaagatggcgactccatcatcccttctctgccagccacatgtacagtaaggagcagacaagatggtgccagccaaggagagttcatttgcatcataagatcagggtggggataccagccttcacccctgggctatgtaaatgtcacacctgatcgaaacaatctgtgagccctacataaatcagacaccgcctcctcaagctggactataaagtccagcgcatctgccaccatgatcactaggagacccctctctctatatataaagagaactgtttctctttctcttctgcctattaaacctccgctcctaaactcttcgtgtgtgttagtgtcctaaattttcctggtgccagactaccaaccccagggtatatagcccagacaatgtagccacctcattgtcatctgctccatttggcatagggataagtatcaagactcttccctagctaattatcttgacttacttcccactcctgtggagcactgacaagaggcctgagttctgatcccacagcaaccacctaataatcctggaaaaatctatttctctctgagccgcaacaatccagtctctaaaatatggacaatggccaggcacagtgggtcacacctgtaatcccagcagtttgggaggccgaagtgggcggatcacttgaggtcagaaatttaagaccagcctgaccaacaaggcgaaaccccctctctactaaaaatacagttgggtgtggtggtgcatacctgtgatcccagctactcaggaggtggaggcatgagaatcgcatgaacctgggaggcagaggttgcagtgagtggagatcatgccactgcactccaccctgggcgacagatcaagactccatctcaaaaaataaaacaaaataaataaacaggctgggcacggtggctcacacctataatcccagcactttgggaggctgaggtgggcggattgcctgaggtcgggagttcgaggccagcctgaccaacatggagaaaccctgtctctactaaaaatacaaaattagctgggcatggtggtgcatgcctgtaatcccagctactcgagaagctgaggcaggagaatcgcttgaacccgggaggcagaggttgcagtgagcagagattgcgccattgcactccagcctgggcaacaggagcaaaactccgtctcaaaataaataaataaataataaaataaaatatggacaatataatacatttgcagcattgctatgaggactaaatgaaatattgctcttaaagtacctggtatagtaggtctggtatataataacgtaatagtcaacgatcatagattttattgtgtgcaggtactgcatgagagttttatgtatattatctcatttgtaactggccaaatagaattatttgattttctcatctgcttccagtctttcacgtctcagtcaagggcatcaccatttacctaaagatttatgttccatatctaggtattttccttgattcctgttttttccacactccactcgtgtaattcatcagcaggttttgccgactctaaaacaaaactcaagtcactcagttctctcaatttccactaccactactctattttaaaaaatgtattggtttggcgttgtggcttacgcctgtaatcccagcactttgggaggccaaggcaggtggatcacctgaggtcaggagttcgagaccagcctggccaacatggcgaaaccccctctctactagaactacaacaaaattagccgggtgtggtggcgcatgccagtaatcccagcaacttgggaggcagaggcaggagaatcacttgaacccgggaggcagaggttacagtgagccgagatcgcgccattgcactccaacctggggaacaagagcaaaactctgtctcaaaaaaaaaaaaaattattattttttgagacagggtctcactctgtcacccaggctgtatgcagtggcatgatcaagtgctcactgcaacctctacctcctgggctcaatccatcctcccacttcagaactgggaccacagaccacagaccacaggctcgtgccaccatggctttttttttttttttttttagtagggacggagtttcagtatgttgctcaggctggtctcgaactcctggggctcaagtgatccacttgccttggcctcccaaagtgctgggattataggtgtgagctactgtgcctggcactgctaccctattttattttatttatttattttgaggggggtctcactctgtttcccaggctggagtgcagtggcaccatctcagctcaccgcaacctcggtctcccaggttcaagtgattctgctgcctcagcctcccgagtagctgggattacaggcgtgtaccaccacacctggttaatttttgtatttttagtagagacggggtttcgccatgtttgccaggctggtctcgaactcctgacctcaggtgatctgcctgcctcggcctcccaaagtgtgggattacaggtgtgagccactgcgccgagccattttattttatttttagacggagtctctctctgtttcccaagctgaagtgcagtggcatgatctcggctcactgcaacctccacctcctggattcaagacattctcatgcctcagccctgggagtaactgggactataggcacgtgccaccacgcccggctaatttttatatttttagtagagacagggtttcaccatgtgggcctggcaggcctcgaactcctgacctcaggtgattcatccccctaggcctcccaaagtgctgggattacaggcgttagccaccgcgcccggtctgctaccctattttaaaccaccactatctttcacttaaaaatctcagaatgtaagttacatgtgaacaggctcggtttattattgctcatagctgcagccccagcacctcaacactcagaatagtatctggcctttctcaggattttgctatgctttgaatgaatgcatgtcgcgacaagcctttgaagtaggtactgttattattcccattttatagataaggaaataggctcctagtggctaaagaattacctaagtttacacaacaaacagcaaaaccaggattcaaacccagtaagtctgactctagagcccactctcttacgcactacacctgcgatactgaactgcaccggcttatgctgaagtcaattattaaagatttttgcgggggtgatactaggagaaatttgagttgaaattccccaacctgataacttttctccaagttttcctgagaacacagctcaagcgcctcttcacagtctcctaggcacaacgatttggtttctcccaagtctctctcatccgcctcttctcctaacaatccagagataatgaactcttttccagcaaattctcctgcttctatccgaaacactcagcctctcctcaacccctctggaaaaaccttccctaatttctcaactctgagggattataacaggcagtacttttccccagttggcagcactactaaaattacttgttttcaatagtctcccctttatcctggctttcccgggtttcatcacgcgcagccaacctcggtagggaaatattatacccaatgacatctgttgagagaccatattcactaatgtttattacagtataataataattgttctattttatcgttagttatttttgttaatctcttactgtgcctaatttataaattaaactttatcataggtacgtaggtataggaaaaaaccagccaggaggccccgcacttcggtgttttctactagctctgcctacctccgtctgcgccgtctccctgactagtttgacccttcgagggccgccgtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgggcgtgctgggaacagagcctggggctggagccgcggagaccgggcgcggagggagggccgttggctgagagttctaaggcgtccctacacctttcttttaaggtggttggcgtttaaagttttaagtttacagttgaggaaatcgtgtcttaactgtgttaagttacaagttgcgtaacctccagatactgtttcctcttcctggaaatttaagcattgatagaggtttgatccgcttcacacgggtgaggaaaagatcgagcgaattgatggatgtgagtgcactttgcaaaccgtgatgattgagtgcctgctgtgtgccaaggcactttaatctttacagtgacctccccgcaccccatcccaggtcggtggtggtatcccgagatgaggaaattgaagctgaggggccaaataacttgtttatttgcgtttggtaagggataggcagtttttcaacctaggtctgtcctcttactaatgctttcttctacatcacactgcctttgcctaacctgtgcaagtcttctaactattggaagcttgacatttggaattggaagagactttgagagaagagagtgcaggcatcctgggtctaggagggatgaaggcttgatgctggtagttcccaatctaatctcttataaaaatatttacccacttttttcgtttcctgacccctgcaccacctgtgccctttaatgtttgcatgggtgcaactttctttagaagtttctgagacatcacacttcaaagtcatctagcttctgaatgagttttaggatggctttggctggtggcccccaaaaaaaacatcatgaggaaagggcctgagtaaaacaaggaatgtgaggaaaatgagagttttttctgttaggtatgttcagcttgtctttttagattacttttcattagttcatgaaacaaacttcttagcatttttaagataaataggtcctgcctacccagatagatagttcttgggaaaactgcagtggcatttattgtaatttgtaaggcataatcatctaagaataggaatctttagcaacagaccttcgggactgatgtgcactctggagtcatctaataaaacatttgaaaaattttttcttgttacaggtgacatacaaatggctgagctatacactaggggttcatgttaaccaggccaaacagtaagtccaatttactaccaattttaatcatattggaatttttttttgttttgttatgctttgcttttaactctacagatagcctacatagattagagctaatttggtttgctggcaatcattggtatttcttggcttgtagctgcgtaattccaatctctgccttcattgtcatggcattctccctgtatatctgtatctttgcacgtccatcttatatgaacaccagtcatactgaattacgaatccaccctactccaatatgaccttgtcttaactaattacatgtgctataattctatttctaaataaggtcacattttaaggtattgggggttagggctttaacattacctttttggagacatgattcagtctgtaatatggatacaacaagttttgtttattcatcattaatggacatttgggttatttccatattttgactgctatgaatgatgctgttatgaacattcatgtataaaacattcatctataagtgtttatatgaacatatattttcagttatcttgggtatttgtgttagtccattctcatgctgctatgaagacacacctgagattgaatttataaagacgaggtttaattgactcacagttccgcatggctggggaggcctcaggagacttggcggaaggcatctcttcacagggtggcaggagagagaatgagtgtcgagcgaagggggaagccccttgtaaaaccgtcagatttcgtgagaactcactatcatgagaagagcatgggggaactgcccccataattcagttatctccacctggtccgtctttgacatgtggggattattacaattcaagttgagatttgggtggggacacagccaaactaggattggaattgctgggtcatgagataattctgtatttaacattttgaggaactgacaaactatttttcaaaatggctgcgcttcttacagtcctaacagtatatgagtatttcagtttctccacattctggttaacactaacactgttttttccctcagacttctcatggatgaactcttttttttttttttttttttttttgagatggggtttcactatgttgcccaggctggatttgaactcaaggatcctcccgcctcagcctaccaactagctctacaggtgtacatcaccacacctggcaaaaactttttattatgtcttattttaaccatcctagtggatgtgaagtggtatctcataaattatgttgattggcattttcctaatgactaatgttgctgaatatcttttcatatgctgcttggccatatctttggagaaatagatattcaaaattatgcccatttttgtcattgggtatttttggttgttgttgagttttaagagttctttatatattctgaatacaagaccctgattgaaaaattatttgcaaaaattttctcccattctgtggattgtctttgtactttcttgatggtgtgctttgaagcacagacattttttgttgttgttgttgtttgagacaggatgtcactctgttgcccaagctggagtgcagtggtgtgatctcagcccactgcagccttgacttccctgggctcaggtgattttcccacctcagcctcccgagtagccgggactacaggtgcgtgccaccacactcagctaatttttaaattttttgtagagatggagtcccgccatgtttcccatgctggtcccaggctggtcttgaattcccaggctcaagcccctgccttggcctcccaaagtgctgggattacagacataagccaccatgcctggcccatggaagtttttattgctgatgaagtccaatttatttatttttccttttgttgcttatgcttttttaagtttaaattttaaaatgattaaattttttttaatcttattttttttttttttttagtagagatgagatcttgctatgttgcccaggctggtctcaaactcctgacctcaagtgatcctcccaccttggcctcccaaaatgctgggattacagatacaagccactgtgcccggcctaagaagatttttttttttcttttttttttttttgaggcagaagccttgctctgtcgcccaggctggagtccaacggcgtgatctcggctcactgcaacctccgcctccctggttcaagctattctactgcctcaacctccgaggtagctgggactacaggcatgtgccaccatacccggctaattttattgtatttttagtagagttggggtttcaccatgctggccaggctggtctcgaactcctgacctcaagtgatctgcccgcctcggccttctaaagtgctgggattacagatgtgagccatcgtgccaagccaagattttttaaattgagaaataaagttgtatgtatttattgtgtacaacattatgttttgaagtatatatacactgtggagtagttaaatctagctaataaatgtattacatcacacagttattttggtggtgaaaacatttaatgtctaccatcttttcatttttcaagaatatatcatcactaactgtagtcaccatgctatacagtagagctcttgaacttattcctgtctaactgtaattatgtatcctttagacccacatctccccattccccctcccctaaccacttcagcctatggaaagaaaattctgctttccacttccgtgagatcaccttttacagattccacaaatgagtgagatcatgtagtatttgtctgtgtctggcttatttcagttaacatagtctcttccaggttcatccattttgttgcaaatgataggattttattcatttttatggctgaatagtattccattgtgtatatacactatatttcctttatccattaatggacatttattgattccatatcttggctgttgtaaatagtgctgcaataaacatgtgagtgcaaatatctctgacatactgatttcatttcctttggatgtatatccgtagtgggactgctggatcatacagtagctctatttttgatattttgaggaacctccataccgttttacataatggctgtattaatttacattcccaccaacaatgtataagcattctgttttctccatacccttgttgtgttttctttttgatgtgttgcttgtgcttctgacataatatctaagaaggctttgcctaacccagggttatgaagatttactcctgtgcttttttctaagattttttagtttttgcacttatatttaattctgtaatccacttagagtttaaaaaaatcatggttatcactatgtttaagttttctacagatcgtgtgcttgttagcatcattattattattgttttgagacagggtttcaccctgttgcccagatggaaatgcagtggcgcaattttggctcactgcaacttcagcctcccaggctcaagtgattctccctcctcagcctcccgactagctggaactacaggcgcatgccaccacacttggttactttttgtattttttgtagagacggggttttgctgtgttgtgcaggctggtctcgaactcccaggctgaagccatcctcctgccttgtcctccaaagtgctgggattgcaggcataagccactgcacctggccatgtacttgttaacattagaaatgcttcagtcgggtggctgtggtggctcagttgtattagtcccaacacttgaggaggctgaggtaggaggattgcttgagcccaggagttcaagacaagcctgggcaacatagtgagacccacatctttataaaaagtttttttaaaacatgagcctggtgtggtggcatgcacctgcagtcttagctactcagaaggctgaggcaggagaattgtctgagcccgggagttcaaggctgcagtgagctatgatcacacctgggtgacagagcaagaacctatctctaaaagagaaagagaggagagagaaaaaagggaggaaagaaagaaaaagaaaaaaatgctttagttcctacagtaagactatactaaagctttcagattaggtgttagttcaagctaatttttaaatgaatcactgaaatgtataaatattgactatatcttctaggaatcacttggagttgattttttgtgtatggtgtaaggaaagggtccagcatcatttttttgcacatgggtatacggttatcccagcattttataattcatattattgtcttggcattttcttgctaattatatgtctttccccactagaatataaactctatgaaggcaggaaacttgtcaggttcatcactgttctgattactattgctgtgtcagaaatcaccccaaaatgtagtgcctggaaacatcattttattatgcgcatagattcttttgctttggaatttggatagggcacagtgggaatggcttatgtctgttccatgatgtctggcatccccgctggaaagtctcaataactggaacctggtcatctctaggcatctttatgcacatgtctggctgttgattctggccatctgttgggcctttagctggggcagtggactagagtgcttgcatgtggtctatctgtatggcctgggctttctcacagcctggtgtctccaggtagtcggacttcttacatagaagctcagggctccaaaagcttgtgttccagcacaatgtagagccaattgccttttctgactagcctcagaagtcaagcagtgaataactggtcataccagattcaagaagtgggctctacttctcaatgagagaatgtagaagagcatatggaatggaagatgctgtctcagccatctttggaaaatataacatgccacaattattctgtcttcagtgtcaggcacataatgaatgccaatacatactgaatgaataccaagcactatggtttatgtttgttttgagatagagtctcactgtatcacccaggctggagtgcagtagttcaaacatggcttcctttagccatgacctcctaggcttaagggatactcccacctcagtctcctgagagtagctgggaccacaggtacatgccaccatgctagctgatttttttatttcgtagagttgggatcttgctgtgttgaccaggctggtcttgaacgtctggactcaagcagtcctcctgcctcagcctcccaaagtgctgagattataggcatgagccaccatgctcggcctcactatagtattttcacaaacatttctctcaagtaatttttttttttttttttgacggagtctcgctctgttgcctaggccggagtgcagtggcggaactcagctcactgcaacctccaccttccaggttcaaacgattctcctgcttcagcctcctgaatagtggggattacagcacctgccaccacgcctggctaatttttgtatttttagtagagacagggtttcacgatcttggccaggctggtcttgaacccctgacctcgcaatctgcccacctcggcctcccaaagtgctgggagtacaggcttgagccaccgtgcctggcctcatactgtttttttttagcattatttcaggctatgtcatacaacagtaaacctgacagacagggtccctcccctggttgatttaaacaagataatttcagactgtgaaaatgctgtgaaataattaagttgggttagagaaagcggtatgggcaatacactgtactcatcctggggaacattatgggtggaactgatcaggagggaagattaatgaattaaaatgggaagctataattaatcatgtgtaggaagtgtatcttgtaagaagtcatatatgttgttattattattattttttttttttttgagacagctctgttgcccaggctggagtacaatggtgcaatctcggctcactgcaacctccgcctttagaattcaagcaattctcctgcctcagcctcccgagtagctgggactacaggcacatgccaccacgcctggctaacttcttgtatgtttagtagagatggggtttcaccatgctggccagctggtcttgaactcctgacctcgtgatccgcctgcctcggcctcctaacatgctgggattacaggcatgagccactgtgcccagcctgttgtcattcttatttaagaatattttatattttgtttattaaaaaatatttggcttaggctgggcgcggtgactaatgcctgtaatcctagcactttgggaggccgaggagggcagattgcctgagctcaggagtttgagaccaggctcaagctatcctcctgcttctgcctccctgagagctgggattacaggcgtgagccaccacacctggcgctactgaaatacaaaaatactaaaatacaaaaaattagccagcgtgtgcctgtagtcccagctacttgggaggctgaggcaggaaaatcacttgaacctaggaggcagacatggcagtgagctgagatcgcgccactgcactccagcctggcgacagagcgatactctatctccaaaaaaacagaaaagtttggcttaaattagataaaacatgttttaaagactcaaaaagtaggcaggaattctttccttttttttttttttttttttttttgagataggattttgctcttgttgtccaggctggagtgtgatggcacgatcccagctcactgcaacctctgtctcccaggttcaagcgattctcctgcttcagcctcccgagtaactgggattacgggcatgcgccaccatgtgcccggctaattttgtatttttaatagagacgaggtttctctatgttggttaggctggtctcaaactctcaacctcaggtgatctgcctgccttggcctcccaaagtgctgggattacaggtgtgagccaccgcacccagccacaagaattgttttttaaaataagagtttgctttgcattttctgttaatataagagagaagaactggggtcaatttggggagacaagtgcatagaggacaatgactgatgatatgggcaggactattagttgtggataaaagatagtgcatttggccagcaagcttgcaagcattttgggcatggtacctgcctatcatgtcttcctttagcatggtccaaactagcatcaataaaccaaaatgtttgtggatctgttagctcatttatccttctaacacaattgttgtaatggaaagaaacattagagggcaaagaggaggaatcagcaaaaatcctgactagggcacctttttgtactcaaggtgttaacagtctagaggggatgcgtcatatgtaaaataaatagttagaaggcagggtgatatgtgctgtaataatagatatgggataaaatttgttagagcttggatggcagaagctcattgtctaggcatgatggctcactcctgtaatcctagcattttgagaggccaaggcaggaggatcacttgagcgcaggggttcgaggtcaggctgggagatataacaaaagcctgtttctaccaggaagaaaaaataataaccaggcatggtagcatgcacctgtggtcctgtttacttaggaggctgaggaaggaggatggcttgagcccaggaattcaaggttatagagagctgcgccactgcacttcagcctgggcgacagagtgagactctatctcttaaaaaaaagatgtgccctggtgacctgatggtgttggggaagggttcatacttcatagaggaggtgacaactgagctgctgtcttgatgagaaattaggtagttgaggcctgagaagagccttctaggcagaaggaagggcatatacaaaggaataaagagaattgtagaatgtttcattaaggatgaagatagtgtaggtatgatggggaatggtcagagatacagagcccagaacaagaagggtcttacctgtcattgctagagatttgaagttgatccttaggggatgagaagctactgaaagctttgttacacttttttttttctcctccctttttgtggaacatggggtctcgctatattgcccagtcaggtcttgaactcctgtgctcaagctatcctcctgcttctgcctccctgagagctgggattacaggcgtgagccaccacacctggcgctactgaaagctttataacaaggaattatgtttcagacaagactctctagcaaccttttcaacatcaacagtgactaataggcattgcaaatttaatatgcccccaaacctaactcctgacttctcccctcaacacctgcttttcctgcttttcccccatctcagtgaattacagcttccttctttgggttgcctagtccagtcatttttgactcttctttctcttacacttcaacacagtatatcagcaaatcctgttgtttctcactttaaaatatacccagaattcatccactaattactacctgcactgctactgccccaaactgagctaccagtcatctctaggctgggttattgcaatagcctaactggtcttgcttcctcccttgcccctctacagtatatcatccacataaccttctcagatccttctgaaaggtgagatcacattacctctgctctcaactttctaatggcttcttaaagtcctgtggtagccacaaagccctatgtgcctggcactctgccctctctcccctactaccgtccttattccactacagcacactggcctttctgttccttggatcttgctgaccttcctgcctcagaaccttggtatttgctggactctctgcctagaacattgtttcccaagatatccaccttgctggctccctccctccctgcagggctctgctaatgaggccttccctaatcaccttatataaaatagcaaaacttctcaggcaccctctgtcctccttaacttacttaactttgtttccatagacttactgtcatctgagattatatattatatgtttattgtgtgtctcctttctagaatgtaagctctaagagtggactttgctttattcactgttctgtccctaaggcgtagaacataaagtaaccacttggtaaagttttgttgattgaatgacttgatttgcattttttaaacttcactctggcagcatcatggataatgaaggtgaggtggggaggagaagaggaattgatacttggaattgaaatagtctagtcaagagatttggagggcatggagtcaagaattacttgggaaggagagctgatgagacttggcaactcattggataggaagaagtgaagtataatgactcccagatttctggcttgcgtggtttcagcagatgatgttgttgtcagagatggatgaaataaaccgaggaaaatatgtagtagggtgactagccaccctgggtttgcccaggatggttggttttgtcactgaaagttccacatcccaagaaacccctcagacccaggcagacaggaatggtcagtcactctaatacatagagtgaaaaaatagctaaagacagaataccaacagttaaggaaagggaggaggtagagaagtctcttcagaaagtaaagcagaagcagtgagaggggtagcagaagactcagtggggcatggttttatggaagctgagagagcaggctcttcaagaagagagtgaacagcaatgtaggttgagcttctctggggatttttaaatttctagctatgcttggcagaagtatattatagacagattgtaaatgtttctcaaaataaaagacatgtctctttgttgtttttaaactagattattgaagggagccaacttctgatacttgctggatcatagagtaaaaatgaatttagagattttactaaaagcaacattatttctgcatttagtatttggctatctcaggttaatgaattattctgaatactgggcaatgtgagtaagctgttacattctgcaattctgaaccggcattaaatctgagtaatcataaaattggaatttcagagctggacatttgtgatcatatacttagtagttcttaatgttttggagtaattcactcttcagaatccattgaaaaccctcacacatctcccaaaaaagcacataaacatttgctgaaactttaggattggagggttatagatggccacctgaatcccaggttaaaagaatcactaatctaatataaccctcctgtttacgccttgggatattaagaggcctagacaaattaattaacttatccagagcttagacagttaccaaactacttcttgattcagtgttctatttattatgtatcattgccactgttttaatgcaggttcagtccctcttggtctattattaatcttatttcagttaatgtactgatcactgtgccagctccaaacacatggactctactccccatgtcctgtctgaagtccatcctttttttttttcaactgtccataggccaagcaaaaatgctactgttcagaaaatttgatggactaccagatttcatttatcttttaagtcattaattaagagttgatcatgtaaaaactcttactgatgtcttacttgtgccttcttttctttggaataggatgctgtatgattatgttgaaaggaaacgaaaagaaaattcaggagcccaactgcatgttacctacttggtgtctggcagtctcattcagaatggacattccgtaagttctcagagccttgtaatgagcttaaatgtgtttgtgttatgaagagtgttataacatagttcaggggagagaaaaaaatcaagattctgtgttatagtagttttaaagagctacttgatggtgatgattattttggatttttagattaaatctaaaactgagaagtttgggtaatatcttggctgtgatgcagagactgtatcattattatgcaataagatgttaggagactgcttctgttattccctatatctctttttttcctcttgaaggtatatggagaacaatggtgtttaattttccacctgttcaaatttcaaaccatgaatacaagtgttcaaaaattataatttttttaactgaacttcttttaattttgaacattcatttgggtaggcttacgtctaagtgcctgaagggtaagagtttttggcaggagcatagctaatgcagtgcataggctgggaacattttattctccttcctcttctttttgtagtcccacctggtatctggtcatctggcaacacaggtgactgctggatttcatcatcctgactgtaaggctttctcaggtctgcttgacttttctcttaactattttcatgtccctctcaggggcacagggatcattctattactcccatgccttggtggctaccagaagctctgctaagatatcttgttccctctcctgcaccaaactgggccttgggaactttaataattccccctctctggcgtcctcccaaaagtaaggcatacctcttctgttctcacttcctcaaacttcctatctgaaggttctttcgggcataaaaagccccatgggacttggcccaaaggtcaggtggccgcttctcagagatccgctgttttcctctttcctttgattttccctcagaatcataagttcagagccctgatttgtcaaaatattgactggatttgttttttagcgattgagtccccagcatgtgagatttaaaactgaaatgccaggctgggtacagtgccttgctgctgtgatcccagccctttgggaagctgggttgggagaatcacttgagcccaggagttcgagaccaacctgggcaacctagcgaaaccccatctctacaaaaaatacaaaaattagccaggcatggtggcatgcgcctgtagtcccagctactcaggaggctgaagtgggaaggattacttgaggccataaggtcaaggctgcagcgagctgtgattgcgccactgcactccagcttgggtgatataaaataaaactggaacgtcaatttagtaatttacaaggagcaacaaaactgctagagggatcctatccttatactctctagccaacatattcttttcttgtttccaagctatttggcaagccaaatgataaccaagatatttgcaagtgtaaaataagatgtcatttatatctctgaagcaaagttaaacagacgtaactcatttacttgcagagataaacctgcctccagagttctgccactgtagagctcttgaatggatactgtcaaagtttatggctgattgtcatattttcttctgtttccagggtcaactgaccttctgtctctttctctaattagtcagtaccctcaatctagtcatattcaagcctttacttggaaatcattatgtttctttaaagcagtgctttttattctttttttggtcattgatccccttgagaatctgaaagaaaaatgcatatgttgacattcataaaattttgagttcatggatcttctggaataggatccaaagttaagaatttacgttttgagataatgtagatttttactcaaactgacccattataacaggggctcttaatttaggattcttagatggtcttcatggttggtcttcaaagtctagagttttcttagatgacactgaaagtgttcaaattgtgttcctcagtgcatatttccgagaccatttttcaaaatgatgtataacctataatcagttaaaaactaagccatggcttgcttataaaaaggtcttctgtttctaagtataagatggcatttaaattctgcctatctttttttagcagcagagtgctttttcaaacaaaatcttaatcagagttctatatataaaatttattaagagtggggttgctgtggttgaagtggttgtgaggatttcagagccctggacctgccctcccaatagcctcactgggaagctctgtggaaccctgtagaacgaactgaccaaatgtggatgcttacctatgccttttttcccttaaagggaatcctcctaaggaaaggcagattattaagcaatatgatcaggttttgttcttttaattcttctattaataatttcctttttaagtttttagtgcttctagaaagaaaaaagacattacgcagctttgtatggaatttattattattattatatatttatttatttatttatttatttatttattttttgagaccgagtcttgctctgtcgcccaggctggagtgcagtggcgtgaactcagctcactgcaagctctgcctcctgggttcacgtcattctcctgcctcagcctcctgagtagctgggactacaggcgcccgccaccacgcccggctaatttttttttttgtatttttagtagagacgggtttcaccatattagccaggatggtctcgatctcctgaccttgtgatccacccaccgcggcctcccaaagtgctaggattacaggcgtgagccaccgcgcctggacttatttttattttttatttatttatttattttttgagacagggtctcactttgtcatccaggctatagtgcagtggcagaatctcggcttactgtagcctcaatctcttgggtttaagccatcttcctgcctcaaccccccaagtagctgggattacaggtgcttgccaccacgcccagctaatttttgtactttttgtagggatggggttttgtcctgttgcccaggctggtcttgaacttctaagttcaagtgatcttgaacttaagtgatctgcccttctcggcctttcaaagtgctaggattacagaagtgagccactgtgcctggcctggatttttttaaatgtaaataatttttatttttccaatgattattataaaaaatgtttaacaatatatagaacgtgaaagcttccttcaaatctcatcccagagattcttccagaggattatttgaaaatttcaaggaaatgtttggttggttctttttgtaatgtgaagaactgtcaacctgatctatgctttatgggttccctgttagcttttcatctaatgattttagctgagattagttttaatcattgcctaaatcattaattcactaaaggttacaaaatggtgatgttttgccttgaactcctgggtccaagcgatccccttgcctcagcttcctcagtagctgggactgcagacatgcaccaccatgcccagcttattttttatttttatttttattagagacgaggtctcactatgttgtccagactggtcttaaacttctgggctcaagtgatcctcctgcttcggcctccctaagtgctgggattacaggcatgaaccacggcacctggcctttctgtttttttagctgtaatttttctgtgaataattttctctcatcaactagccgtgttttccctgttatgctaagaacagagggcttaccccctcctaggctctgggtttgtggatgctccctaactcccgtgtccactttaataggaacccattgaatcagagctccactctggtctgcattgttttagcaccagctggcatttccattctgttgtttttatgtactttcagtatcccccagggcagtatatagccacacggacctgtctggtctattcagatcttctcatgaggtgcgaattactgtttttagggctcttactgcaaagctgcattggttttgagtggttcattcctaatggtctgtaatttttataataagctctgtaatttttagtgtgcagttttacggaacatgacttttttcttcccttgaataaaccaatgaaaatgacatttttaggagtgccagttttaagagaaaatgcattatgagaacattaataatcccagctcaaacttatggttacactttttaaaaaacttatttgatgtttagattgctgttttttttatgttgtgaattttggtggttccgaacattaacaaaaatatctatttgctttagacaaatacacgaggtttagaaaagcaaaacctgtattattaccaacaatttgattactgaaaataagatttctttgcagttctttgtctgtaggatatgtcctgctaaggatgcacagtcatcctgtattttagaatcacttgaaataattcctcactgtactgaagccaccaattcaatatctagttcaattcaattttttttttccattttgctttcaattgataggttccctcctttcccttagaggtaactgttacattgagtttgccttctccttccattgtttttgatatatatatatatatatatatatatattttttttttttttttttttttttttgagatggacttttgcctgttggccaagcattggagtgcagtggcgtgatctcagctcactgcatcctctgcctcccaggtttaagcagttctccacctcagcctcccgagtagctaggattacaggcgtccaccgccacgccctgctaattttttttgtattttagtagagacggggctttgccatctcggccaggctgatcttgaactcctgacctcgtgatccatctgcctcggcctcccaaagtgctgagattacaggcgtgagccactgcgcctggcctgttgtatatatttttaatataagaaaatatatattcattttgcctctctttgttagataaatgttttcatacgtgcaaactattttacactctgcttttttttacataacagattcagagcatcactccacagcagttatagaaatattcctcattaattattacagccacatagtgccacattgatagatataccttagcttattcagcaatcccttattggtagttgttatttatgatctttggctattacaaatattaatagtgctgtagtgaatagcttagtgtctgtgtgttttgtatatttttgctagtgtgttttagggttacattcctagagtaggattgctcggtcaaagggtgagtgcatgtgtacttttgttggatgttgccaaatatcactctgcttcttgttcccaccaacaatgtatgagagtgcctgtttccatatagcattatgttataatatgttttagggctatttatatttctttttctgtgaactgtctgttcctaccacttgcccttttttttttttttccttttttgagacgaagtcttactctgtcaccaggctggagtgcagtggcacgatctcagctcactgcaacctctgcctcccaggttcaagtgactctcctgcctcagcctcccgagtagctgggactacaggcatgcaccaccatgcccagctaatgtttgtatttttagtagagtcaggttttcaccatgttgacgagggaggtctccatctcttgacctcgtgatctgcctgcctcggcctcccaaagtactgggattacaggcatgagcagccacatctggcctttcttgcccattttctaaagagttgttagtctttgttttctttaattttagaagttgtgtattaaccctttgtgatgtaagttgcagtttttttccgctttatcatttgtttttgtacttacgtttttttttcatttaaaagttgcttttttaaaatagattatttcagttatttctggattttgaattatacttaggaaatgttccctctttcttagcttatagcaggttatagaattcacacatgttttcatgtgcatatatgtgttcttctcttttttttgagaccaagtctcactctgtcacccaggctggagtgcagtggcacaatctcagctcattgcaacctccgcctcccaggttcaagtgattgtcctacctcacccccctgagtagctgggattacaggtgcctgccaccatgcccagctaatttttgtgtttttagtagagacagggtctcaccatgttggccagggtggtctcaaactcctgacctcaggtgatccacccacttcggcctcccaaagtgttgggattacaggcgtgacccaccacacccggccttattttttacatttaaatctctaatccatttagaatttattttggtatatgatgtgaggaacagatccaatttttatctggttccatgtgattatacagtaattcttattaaatcactcactaaaaagcctttgctcacactgatttgagatgctgtatttttttaattgtagtactgaaatctgtgctagatcactttccttaaccttattgagaagttttaagataagcaaattattattttttttcctgaaagtaagcaaattaaaagtgagtctgactttattaaattataacatatgttttaaggagtgcctggtgttttcctaatttcacatccaagcacaattgaattattggagcaaggaaactaaaattgcagattcttacattaagcactaataaagtgttattttcttacagtgccacaaggttgcagtagtgagagaagataaattggaaggtaagtgttttagtgacttagcaagtttttcctcttatggcatcagtgtaggtgcaataaaaaatctgcctctaacatctgcgtataatatatttagctatttaactgaatagcccaatattcattttatgagtagtttttaaagcatgttaaaatatgatactacatctgcctgacttcccatttttagggccaatagttgctgacatttataaagcacttttatcacagaatttcaaaactcgtgacacatgcagaaactgttatgaataccatatgagctacctcatcaactgtgaaaagacagtggcagtttttttaggaaacaagttaaagaatgcttttctggaagtcagaaagacttctaaataacttctaaattaaatttgtctaactgtttcaagactatcagtgctaccgttggattgtttaaaaacccaattcaaaggaatttaataacagtcagggtcctcatgatcttggacctatatctcaagataaaacctgtactgttgtactttgtatataaaggctccttggcctgcaggccccatttcacagattgggactgaggagggtggagggcagccacgccagggacacaaaaaatatgtgtattttaaaaagaaagagttcctgtccatgggggtagggtgggggtattttaccaaatttaactctgaagtattcagagtggtgggtttgtccactttttactttctgaattcccacagtgttaagcaaagcaaaatttctttattctgtagatatgtaatgatgatctactatgtgccaagctctatactaggcactggggacatggaacaagttagctgcaatcccttccttcgcggaacctaacatttattcttgtggtgttcttttgtgtttctcttccgtagacttatctagttagtagtgtttttattacagagttgctttctctaaactaaaattgaaatatataaatgaatattctcagatagaaattacttagtactctttaattatatgctatagtgtaaggctcttttctgaccaaaagaaaaagatcatcgtagtcatcatcaatcattaatatttactaagtgtccactggatgagtgataccctctcaggtgctgtccttagaaatgactcaccaccacctaccttgtcataatgtccccattgcagacagaagagttgatgtttcactgtatatgtggctgtgtggcctttagagttttttggaccaccacagattacaaatgctttaatgcagaagggtttcttgttaaagtccccacatgctatgaagtttgtgtattaactgactgcttttcctgttgacttgtagcagtgaagtccaagctagctgtgactgccagcatccatgtgtacagcatccagaaagccatgctaaaggacagtgggcctctgttcaatactgactatgacatccttaaaagcaacttgcagaactgcagcaagtaagcgtcttaatgttccttgtgggcttctttacgaattgattttgtaagatgtttacacagtggctgcctcttaagagtgaatgccaagtctagtaaaaccccatttatcttgcagtaagaaacatgcctggttttattagtacatcataaggtgaaaaatagcagccacaacccatattgaaaaccccagtggactctccataaatctatttctcatgtatttatcctgtcactgccaccagaaatgtttgtcgtgccctctctaactcccttacccagtctctgcttgtctaaatcctacccatccttcaagaaccagttcaaacgttgtccttaaaaaaacagttcctaatttgatatccctctacttttcatccaaaagcaactttttcttgagcttccatagccaggatcaggtttttttttaaatcttttgtatccttaacagcacaaggaggtaacggactataatgcgtgtacattttggaaattggtggtcacaggcttgatttgtggctttgctgcttagtagcccagtggcattggacaaattacttaaactctttgagctttggtttctttgcctttaaattcaatgtaataatgtctcctttgtggggttgtattgataattcagatcagttccccagacatacattgagcacctactactttgacaggtactgagcaaaatcatttgaattcattcagcaaataactcatgagtacctatgacataccatacagtatagagtgaatgtgcccgcgtaccttttcatgtaactgatgggagacaggcagttatggtacagtgtaagagtactgtaataggaggaatattgggggaagatgttggcaggggcacttatctcccacttttggatggatagagtgaggggacaagactgttatgacttatgacacagaaggttatgatatctcagttgaggcctgaaggcccagtagaaatagccaggcaaaggaaaaatgagagactaaggacagagctaagagagaaaacatgcttgtgcagaaccatgatcgttttctatgggtgcaacttagagtgaaaggtaggaaataattagatagaagactaaagaggccaagcaggaattacattatgctttgactactaggataaaaatttagactctattctgagagcgctggggagccactgaaaatatttaagcagatggagtgaaattatcaaaattgcattttagaaagattgctctggttgcagtattgaagataaatcagaagagaataatctggaggcaaggccatcagggaggagaaatgtggcagtaatccaggtggatatgacagttttctaatgtgaagttgtgctgttggggatggagaagtatgaaggttaatgagtcatgaccatcaaaaaacctcagtttggccgggcacagtggctcacgcctgtaatcccagcactttgggaggccgaggcaggtggatcacgaggtcaggagattgagaccatcctggctaacacggtgaaaccccgtctctactaaaaatacaaaaaattagctgggcacggtggcaggcacctatagtcccagctgctcaggaggctgaagcaggagaatggcgtgaacacggaaggcagagcttgcagcgagcagagatcgctccactgcactccagcctgggcgacagagcaagactccagctcaaaaaaaaaaaacctcgatgtatggtagtggttggggacaaggtgtgtgggggtaggggatggtggaagacagcctttcttggtattgaaaggttgatacccatgcttctggcttgggcagctgggtactaagaaggggaatataacaggaggagcaggctttaggagagatagaaaaatgacaaattgggttttagagatgttgagtttgagaagcttgtgagaaatccaagtgaggatgtccatcgcaaaagataggtgaatctagagctaaggagagaaatctggggtaaagatagagattttgaaatcagaatagtaaatgggccatagcagtagatagagttatcagagagaatgtatagaatgaaagaagggcagaaagtaaaactctaggccaaagtactagttgtctgaccttgggcaaattatttaacctctcagtgcctccctgttcttgtcagtaaagctgacagtagtaccagccagatagggttgtagaggattaaatggactattatatgttaagcacttagaatagcacttggcacatagtaagcactatttaatgatagctgcttttcaagggaagaatagaaaaagaggggcccaaggggagccaccagagataagagtatatggggtttcagcccctaaggaaagaggttcaagtaggaggaaccagtcaacaatgtcaaacaatgctgagaagccaagtaagttaggaagtgaaaattgtccatgacatttagtgatagccttggtaagagcattttcagtggagtgaccagattctggtgagctaagtaaatggggacagaggaagtgagacagcaaatatggacagctctttccaggagattagactgcaaagcagaaaagagggtggtagctaaggagggattgagacgggaaggatatatacatttcttaagttgagaatgacttgaacttgggttgttagaaaggtgctgtaggaagaaaaggttgaaaatcctggggaggtggtatgactgataaagatgggtcctcaaggagagaaagatatagaattgccatagtttctataagttccatgagaatagggatcgtgtctaaattgttaactatatacccaaaatagtgcctggcacactaataagtagttactgagtgaattaatgatagacattagttctttttttttctttagctcaaaaccttgagtataataagcatacaaatatttattaaataaatatatggccaaagaggaataatttacaagtctcttatcttttagggaaggatttcaagaaaatattaacaccctgataagtttatttgaaatatattactagatttcaaaaaattttaaaatctagttgggtattccaggctctaaaaatcagttcccttgttatatctagcaagtaagcaaacaagaataaaagtgacgcaaaagttcaaaatgaaatctgccagggcccactaaaataaacatggcaagtagaaatgtggtaataggaagcacttcagtgaaactttacctaaatacttaaagtatcctcagtagaaaagtgaatttatctccaacaaatgagtttgtatttagtcctgagaattatgggccaactgagatctcacttatgatttcgtgtgttttaagaagtgccgtgacatgaagagagttgaaattttaggattgagcagagatctcttgtcatcagacatactcctagcctaactcggtctcttcctcattgccaattcctggtcctgaccctatggtgtagaattcagaccagaggagaaagagttgtttcaaggccaacttcagacgttgacagtgaaataaaacattactcttttccttgtatatggaagcactgcaaggtcagagaggaagagcagtgggtgaaagcaaatgatttccgtctgttcttaactctgatgcataaaagatgtgtgtaaatacagagttttctgatgaagaccataataaatcagtggaagatttttggagcttttgactctagctttggggctgcccagtctaaagttacttctgagatgaaatgatgtatcagggatttttttttttcattaggccaggtattctagcagttaatcttgaagttgtgcctggttgatcttttaagataattgccatcaccacatagtttagaaatctcccaccccaagttgaaggtgatacactaaagaagggagagaagccagaagcctcactttcattcacttagtcattctttcaacatgtcgtttccagcacttttctatgtgccaggtcttgagctgggtgcctgaaataaaaaagataaataagacttcaaggaggtcttacatatgctcaataagcaagactgggaaaaataaaatatttttctttgttagaaaaagctggggaactttgctttaagtacaatcctttgagaaggctaaatcaattacccattcacaatgtggaatgttacattatggatttgtgtgaaacggcacttctataatgattagagagagatgtatgttccctttaatatgccacacaagctgttccaccaattttcttctcttggccttgggcatacttacttgtccggtgctgttagtattattagaaattattaacaaatggctgtaaaggactataggttataggagccagtggctctgcttccagcttctcccatttttttttgtttttcattttgagacagagtattgctgtgtcgcctaggctggagcgcagtagtgtgatcttggctcactgcaacctctgcctcctgggttcaagcaattctcttgcctcagcctcctgagtagctgggactacaggcgcgtgccaccacgcccagctaatttttgtattttcagtagagacggggtttcaccatgttggccaggctggtcttgaactcctgacctcatgatccacctgccttggcctcccaaagtgctgggattacaggcgtgagccactgcacctggcctcttctttgttttaaagcatgatttatttatttattttgagacagcatctcactctgttcctaggctggagttgagtgatgagctcatggctcactgcagccttgacctcctggattcaggtgatcctcctacctcagcctcctgagtaatcagggctataggcatgcgccactacacccaactaatttttgtattttttgtagagacaaggtttcaccatgttgcccaggcccatcttaaattcctaggcttaagcgatccgcccgcctcaggttcccaaaccgctgggattacaagcgtgagccaatgcgcccaaccctacagcatgatttactctggccaagagagttgccaggaaatttgttaatatttaaagcttagttttgattcagtcaatattgcaaatctagccctatcagaggaaggtctttaaaaacaaaggctatttcatttcccaaggataatgaaattactgcatcttttattattgttggttgcattcctactcttttgaattagaatacttttatcaaaaacaagaatattcaattagtggtagaaggcacctaattccaatcctatctattactaactagatgtataacctagtaaaagtgactcacttctctctaatatttgtttctttatgtaatagagagtttcatacatttttctaaagtcgattctaaacaatattagagttaagtattgtgtggaagaagcaagagtttgaaaataaagttttatactgacattagttttttttttctttttttgttgaaccacccaagaatgcatatgctgacattaacttaatgtaacatttctgtccccagatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgtaagtcttctttgaagataccccttcattgcagctcagagtgggtaactagaaaagcattaatggttgcagtggtagtagtttatttatataagattctgatattcagttctgatttttctactttagtttgaaccctttaatacttgatattgttatctgaaagagttcttttgcttttgataatgattctcaccaaaccttggatttcctttgcaaaatggtaatgcctaccttgtgcacattacaagattgttgtgaaacccagatgaaaacatgtgaaaacacctcgagaattgttgacattcaaaaaaatgtttatttgcaatatgtctttctgaggaacatcttatattctgggctttgcaacatataccttccttcctagtgtatttcccattcttatactttatgcaggtttttttgttttgtttttgccttatttgcttctcttagatttttattgttcagtcatctgaactaactcaagggcattgacttaagaaaagtatcattaagatactattttaaaaatccagaaaagcataattattgttgttactattattattatcactgtcattttccagtgtcaagtgtatttaattcagatcactgtcattttcaagcgtctgtcttgggaaagaagaaggatggaggaaaacactaacgtttattgaatttcaactgtgtgccagtgtctttgtttaaatcctcttatcagttctgtgagggagatattaactatttccctttcgcatatggtaaaactgaaacctagacttaagtaatttgcctggagcccatattgctactaaatggtgggaaccaggaattcagatctacttctgatgattaaaaatgtaatgttttaggttttcccgctttgtgtacatactgcctctgatcttttttaattctgtcaaattaaatagtttttaaatgtgctcaagaaaagtttagctatatccatggataattaattttataagatatataagaaactaagctttagagattaacaccagttactgtctggtgtggattattgttctagatttgttcttatatctaacacctacgcgttttggcatgattatatagagactataccatcgcaacagtttgctatagaagagtttgtttgagactgctacttcatgaacagcctaaatgccagcaaaaaatcatatgtgttttctgtgcttgtaggcatctgcagcaggcaacaaggcaccagggaaagggaatatgatgagcaacttttttggaaaagctgctatgagtaagcatgttcttacctcactttgactaacgaatgaatgttaatgtaatgacatattatacctgaagtgaaagccactttgtctagtttttgccaatccaagagactacctgcattctaacaaatttccagtgtactgcccaatatattgatgaaagtaactcagctagaactttatgggtgagttaggctcagttgagatctctttgagagcagtttattattcctggtttaacttcctgccttgaaaagataatgaactatttgcttcatagggcccttgaaaatgggtgattaaaataaaagggaggctgcctggctacgcagtatagtgttgaggttaataacgtggatgctagagtcagtttgcctggtgtgacctttatttcttctatctctcaagggtccacaaaagcaaatattttgcctttcttcagttattttttgcagattactcacagtaatgaattagacttccagtgtgaattagaagggcccaagtagtaatggacatttaaaaatcttttttgagaaagcaaaaatcttctttatttttaaaaagatacttaagtaagaattctttcgtatggaaagaaccagtagtcacatattttcatacttctcatatcaagtgtacatcccctgagagtatgtggtagaataccaggaagaatgcaggagccacaggataattatggcacactttcttggagcatcagttttacaaagatttttcaaggaggcattttgttacatgcctatgcaagcaaaattagttagaattctgcctttccatgatggctaaattggtggtcacgggagggattgaagtgacttttttttttttttcatattctgcttatgtaagggtgacagtttttgtgtttgctgtaaaagctatcagagaacgtttttgtgttcttgcagctcagaatgggtaactagaaaagtgaatggaaaatgtgatacttaaaggttactcggaagcattattgtattactgcaggcacagttggtgcacagggaatgcttcctacttctgttaaaacaggtctccaacccacagtccactgatgggtagcagtccgtggcctcttgggaaccgggtggcacaggaggtgagcagcaaatgagcaagcgttattatgcctgaactccacctcctgtcagatcagtggtggcattagattcttataggattgtgaaccctattgtgaacagcacatgtgagggatctagattgcgggctccttatgagaatctaatgcctgatctgaggtggaacggtttcatcctgaaaccaccgcccccgaccccccaccgccgcccaccaccacccctgtctatggaaaaattgtcttccatgaaactggtccctggtgccaaaaaggttggggactgctgtgttaaagcatcatgctgtcactgacctgcctggctgttatggttttttttaaaaaaatcaaaccatacagaagtatgcttatttaaatcatgtgtttagttagcaaatagattgagcacctgctatgtgcatggcattgttatgcagtggtgatacaatagaggaaaaagacaaacaaggtccctgccctcaagtccttatattctactgagagagatggacaaataaatatggaaaaaaagccaggcatggtggtacgtgcctgtaatcccagctactcgggagaccgaggcaggagatttgcttgagcccatgaattcaaatccagccaaaaatgtagaagacctcatttctttttatttatttatttatttattttattattattattatactttaagttttagggtacacgtgcacaatgtgcacgttagttacatatgtatacatgtgccatgctggtgtgctgcacccattaactcgtcatttagcactaggtatatctcctaaagctatccctcccacctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccgtgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtaagaccccatttcttaaaaaaataaagggaaaggaaagaaagaaaacatttgaatagtggatgattgtaattgctaggtaggagtaatagggtgttatgatggcatgtaacacggtgagggggaaaacctggataaaataaaatactattaaatattaatctaaaaattgcttacaaagttaatttatttgacatttcttcaaggctgaatgttcagagtaaaattatgacttttttattgtattcgacacatgacaagatcattacaatgaaaatgaagcttgagaattggatgaagagagttcactgtggggacttgaaccatttaaaacttaatactggacagtaacaagtgttggcaaggatgtggagaaattgaacccttgtgctctgctgtagggaatgtaaaatgatgtgtactcactttggaaaatgatgtggcagtacttctaaaagttaaacatagagtttacccagcagttcctctcctagatatctacacaagggaattaaaactgtatgtccacacaaaaacttgtacaagatgttcatagcagcattcttcataatagccaaaaattgaaacaatccaaaagtctgtcatctgatgaatggataaacaaaggtggtatatccagacaatgaaatgttattcagctataaaaagtaatgaagtacagatggatatgtgatatgacatggatgaaccttgaaatattaagtgaaagaagccagatagaaaagatcatatattatttcatttatatgaaacgtccagaataggcaggtctatagagacagaaagtaggggccgggtgtggtggttcacgcctgtaatcccagcactttgggaggccgaggcgggcggatcacgaggtcaggagatcgagaccatcctggctaacacggtgaaaccccatctctcctaaaaaaatacaaaaaattagctgggcctgttggtgggcgcctgtagtcccagctactcaggaggctgaggcaggagaatggcgtgaacccaggaggcggagcttgcagtgagccgagatcacgccaccgcgctccagcctgggcgacagagaaagactctgtctcaaaaaatatataaataaataaataagtaaataaaggttgtcaggggctggactggggttgaggaggaatgctaatgggttcagggtttctttctggggtgatgaaaatgctctaaaattggacagtgatggtggatatacaactaaaacgctgaatgtaaagtgatgaattttattgtatgtgaattatatctcaatttttaaaagtaacgctttatatgtaataaaattcagcattgatgacaaaatttaaaggtcataattggttatctttatttgcttgaaaaggtttcgtgttttcttgagtataaaaaggaaatgcttttaatcagctagaagataggtgacttgatcattcaggtaacaaaaaaagtcattaaattttccttaataattgccttacaatgttgcattaaactacctctttaccagttaattggctattggtagctgcatatatgtttaagttggagttctcaaaattctgtgaaaccaagacagaagaaactctggatgctgaatctaatgtttgatcagtggcattttaattcagatcagttttctgtaattggtaaactcaatgcaatagcctctctttccttaatccataggtaggtaggaagtatttggaggtttttttctcctaatgatgcaatttttaaaacaattgctattaaaacaatataatttatgtgatagattgcaaaatttgcataaattttaaagctacacatgtgactccagtgaactgtattttttggattggctgttgacccctagacccctggagatgcatgtttactcttctatacaatttgggatatttgagaggcactgatacttgagaacaacagttgaaaatgcaagagtatgccatcgttgggaaggtggattccaccattcgcattttccattcaagtcttcaggaaaaagaaaagtataaatagattgcattttacactttggtccatcaactacccttcaaataatacacattatttataaattattgtactaagctatgcataatagcccagactatgataccaatttttttctacactgtagatggtttaagctattatacaacatataaccaaaactacttattgaagcacctccagctaatgacagctttctaatagtattttgtgcctttacttgtgaaaagctatcactaagtacagcgtgaaggctagatgacatgcttctatagttcctcagatggctaggcctgtttgcatttcttagttctccctgctgcactgtagtcattcttcagcttggtgtagggaaagggttaaggactttgaggagttaaactgactttggttcaaatccctactcttttctgtcagtgttacctggataaatcatttaaccaatactgatctcttttaatccttatgataatcttgtaaatattatctcaggtttagaaaagactgacttagataaaataacttgcccagagtgaagcggggtttgaaccaaacttctttgactccaaaatagtctttaaattttatcattaaggtagtagtgagatattaagggtatccaggcattaaaagatagaatatatagaaagcaaaggtcttgctgcaaatcgttgtcaccatttgtaaactgtgtattgttgggaaacatcttgtaatccttctgattcttgattttcctcatctgaaaatgagaaggatgatgcctcataaagttgtatgtgttttttctaagccttgcttttactatcatttagcctgggggctgtgatacaatgagggattagcaggaggcagaaatgaaaagttacagttagagtggtagttggaaaggaggaatgtttctgaatagtccatgagctcctttttgcccctgctcctaacatattacctggcacatggtagactgtcaaaagaatgatgtattaatattgcatgatggggtcatatgtcgtctgctatactttatttatagataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaaggtaggaaaattttgttgcttattggggaagagtctttactgggggtgagaaggtctctttgggcttattgacagcaggcagttttcagttaagtactaaatcctacttaatgcctaagggatacaactatacaaccaaaatggaaagagaagcccagtagcttatctagtggagtaggaccgtaggatcagccagtttggatgatttaaggaccaaagtcgtgtttttggccgtattgatctaaattgattgttgatttttgttttaaatttgtggacatggcataagtgtgcctagttgtgtgtgtgtgtgtgtgtgtgtgtgtgtgtgtgtttcacttcaaattgccaaatgaacagttactgtttccagtcaaatttaagagaaaaacttctttgttttctttttatatcaatgagtttatttttcaagtggtaaaatgtaattagaaaagaaaataaaaagcacataaagctattaaaactagatccaggaattggagacactacctcatagttggtagaattagtctgctgaaagaaattctaaaggacactgtcaacactgataggcctagaaagacgacttttgtggcaagtttgggactactctcgttgaaaacatcaacaaaatggtgaaattttagagggttaaagctctgtccagtgggcctcaccacctaggaacatatgacttgtatggattaaaatgtccacaaccatgggtacgtcactcactgttgatacttattgccagcagtgcattcagtatttcactactaaatgtgatgataaatgtagatttttaatagatgccgttaaccagattgaggaagttgttttttgttccaagtctgctaagaggttttatcatgagtgggtattgattttggacagatgcttttttgaattgattggatgctcagatggtgtttttattaatgtggtgaattacactgattttaaaatgttaggccaaccttgtgttcttgggataaactccacttggttatgatgtattatccttttttatatattgctggattagatttgttaatattacactaagcatttgttgcctgtgtttatgaggtctacaggtcagttacattcttttctggtaatgtctttatcaagttgctgtgtcaaaattgtgctaacttcataagattactcatgcgctgcataacgatgtttgggtcaacaatgggctgcatatatgacagtggtctcgtaagattataatggagctgaaaaattcccattgcctagtgacatcatagctgtcatgacatggtagcgcaacacattcctcacgtgtttgtgatgatgctggtataaatatacctactgtgctgccagtcatgtgaaagtatatcatatatattaatagttatatatacataatacttgataataaaaatgactatgctactataattactgcactatactttttatcattttagagggtagtctttctacttataaaaaaagttgactgtaaaatagcctcaggcagcccttaggagatatttcaaaagaaggcattgttatcataagagatgacagcttcatgtgtgttactgcccctgaagaagaccttccagtgggacaaaatgtggaggtggaagacaatgatcattgatgatcctgaccctgtgtaggccgaggctaatgtgtgtttgggtcttagctttcaacaaaaaaagtttaaaaagtaaataaaaaatttttaaaatagaaaaaggcctatagaatagggatataaagaagaaaatatttttgtacagctgtacaattttttgtgttttaagctgtgttattacaaaagagccaaaaagttataaaattgaaaatacagttaaagtaagctgtttattattgaagaaagaaaaacattttaaaataaatttagtgttgcctgagtatccagtgttgataaagtctacagtagtgtacagtaacatcctagggccttcacatttcactcaccgctcactcactgactcagccagagcaactttcagtactgaaagccccattcgtggtaagtgccctatacatgtgtaccatttttaatcttttttatacagtatttttactgtatcttttctctttttagatgtttaaatacacaaataccgttgtgttacagttgcctacagtattgagtacagtaacaatgatgtacaggtttgtagcctaggagcatagactataccatctaggtttgtgtgagtatactctgtgatgttcacacagtgaagtcacctaacaatgcatttctcaaaatatgtccctgtcattaagtgatccatgaccgcagttgggagaagtttcctctgttttctgaaggagtttatatatacgtgtatatttttcaaatgtttaataaaatttaccagtgaatccagggctggattttatttgtgggaaaggtttttattgtgaatttgatttaactagagctgttcaaattctctagttcttcttggatcagttttgactgagttgtgtttttaaaactcagtcaaaatttgatctaaattgttgagtttattggcataaacccgttcattatataactttattcttcgagtttgtagaacctgtactcgatacagatttctttactgtttcattcctgattgataatttatatttttctgttttcaaaatgggttttataaaaggcttattaataaaattaatctcccaaaaataacaactttggctttgttaattttctcttattttttatctcactgatttctgctcttatctttattgtttccttttactttgggtttaattgttctttttctagttcaaggtagaaaggaaagttggtatttaaagttatataggacataaggtacttgatggcaaagattatgtcttgtatatatttgtttctctaacattcagtaggcctttgataaattacttgttggttgcatgaggagtgtgatggagtatccattcatccagaggagctaaataatgtcatgatggagtctaggattttttttattattattatgtcattagaatcaccttaaaaggatatctctgcctttgctcatattgttctttctctttaaaatatgtttcccctttctacatgatgaacttctacttagcttttaagttttccaaatatgaattatattccataacattttatttgtccagttaaatctaccacattgccttatagccagtggtgtttgccagagcttcttgaaaacagtattttcttctgtattgttgcattctcaatggctagcaaagagccttgtatgtatgtagtagctgcttatttaatgcttgttggataattgaaaggccaatcagggaagtaagaaggaatttggaaagattcttgataacctggttgtagcttccagcagtctctagagaactctagaacttttttattcaagtcacctcatgaagtgacttagttgtggtcagttagcagagtatccttaacaagagtccttcttggactatttggccgtccttttctaccctctggaattaagaccacgagttataaagcaaaacccataagagcatgtgaatacttacatttttgttctgtgtaacacgcttaatttatttctggatggcaacagggggaagcgagtagcattatctgatgatgagacaaaggaaactgaaaacatgaggaaaaagaggagaagaatcaaacttcctgaatctgatagcagtgaagatgaaggtgggcattaccattcattttgggttagggggatcaattttactttcaatgttcaaggagctaaaaaagtaatggattaaggatcacaatgagagtagtaattctagcattaagagacaccatagcacctctttctgtttgaaatctgcattagccttttgactagaaccatgatcttttggaaatttgtcaaaataacacagaaggaaagaggataagaattattattatacatattatctaagactttttcttttcttttcttttttttttttacttttaaggggaggatattcctttagctaccttcatgtgaatcttttaaaaattgtgacgttctaggcagccagggtattactggtggtggtccacacaggtaaaactagggttaactggaacaacctacagtgtcattgttagaagggaatgacactgtggacccttctagttttaggctgtgggcaatgttgtaagataagcaaacctcataagggcaagagttttaccgggaacattaatatgcttttaaaaaaatatcaagtattttgaagagccaagatcttgccccaaattgtataaagtatatagaaaaagaaggaggctaaaaagaaagttaaatgggttgaactgatatgctggacgactctaccttgaaaagcccactttgagacacagtggtgaaaagtttgaactgctctaatcaattgtccatgaattcatggcataatgggtataaaacattttaagtaatgaggggaaatctagtccaaaggatttcagcatcacataaagatacagagacaaacacgaacagatactaaaagggagagtaaagaagaataatgaatgcaaaaaaggaacctactgagctatcaaaggacaaacttgtaagattctgaaacttgtaagattctgctttttccagaaactactctaagaggaattgaaaatggtaagagaggcttccgaaaaaaggatattagctcaactatacaagtgagtgaaaaaaaaacaaattatatatacagttgacagtaatgcaaaagaaatgaacagacccaagaaatagtagcaggaagctgaatctgtgataaaggtgtagcatctttgacacttctgtggatttagattctaccattcatgctatgtgtttagaattacagcctgtgatatcctgtgagaggtacaatgtccttccgtgggttttagtggctctttagaatgggtaggagtaagacacgtgagcatcccagagaggcaaatgctgtattttcattccattgtcatttatcaaaatgctttggccaaggctgctgaaaggaacaactccatgtagacacatgggaaaataattaggaagtaaatgtaggaataggtgctaattggaacagtcttccctatttccaatcagtaaaagaccttgggaagattttggaaaggtctttgaagctatcaactagatactctagtattagtaaaggagtcagttctaagttaaggaatgactatggttggttgagcactcattatatccttctgaaatattccctatagttctgatctgtagcctacaaaaataatactgttgggtgattagaaatgtgagtggggttatttagttttgaaaggaatgtgaagaaatgcaatagaggtacacagcctataataacagatgatatagagcagaagctcttagatttttttcctctggcaaagataatttttggcatctgactaaatttataaacctctgacattttattcttaaatttcatctttgtatcaaagccagtgggattttattttcaacctttacacagtctttaacttattattgctttatttctgttacactgaatatgtcatattagttcaatatgctgtcttcagccagaagttagaaaaggaacagcaggagtagagaaaatacaagaactttggagtcaggcagacctgggtttaaattttaccttgaccacttattgtgtgactttaagcagattagttaacttgtttaattccttgtttttgcatctctaaaatggggatttttatcacagatggtataggctttttatgaacatgaaataagatgatgtgtcagaagtgccaagacagtgcttggtacatggttttcttttgttttgtcttgtcttttttttttttttttttttgagacggagtcttgctctgtcgcccaggctggagtgcagtggtgcgatgcgatctcggctcactgcaacctccgtctcccgggttcaagcgattctctgcctcagcctcctgagtagccaggattacaggtgcctactaccacgcccagctaatttttgtatttttagtagagatggggtttcaccatgttggccacgctggtcttgaactcctgaccccgtgatccacccgcctcggcctctcaaagtgctggaattacaggcgtgagccactgcgcccgtcctgtttttttcttttacctgtgtctggaaacaagttcagatagttttcttattactcactctactcttcctgctgaggtgcccatacttgcaagtaccttcaattttttcagaaaattcccctccacttctgtttgtaactttctacccaagggactgttcctttctcttttacccctgcggggtcataagcacctgtagtactatatactctctttttaaagcaaaaaaaaaggccagacccagaaagaaataacattaagaataacatctacattgctaggagaaatgtagttttaactgatatagttaagtctttgctaatattttcagtccttgcaagttgcttatggagaatgttaagcaaatgatccccatttttaggtaaaggtaggtatttttaaaaaatagtcctaggaagctgtgaatggtttccaggaattctaattacctgtctctgccagagaactctttgacacactggatctctgaaattagtttcattgcagtttttattctgtcccaacaaaggttgctttcctggaataagtgatatttcattacttaccttttgcttgaagagctgcagattggctacaaatctgtttaaaatacaccagtgcattggacattctttatgtctgtgtcagtaaaaatgtattgagtggggatgtttggcttggtaaagactaaggcagacagacatatattctagtacatgaatggcggcacgtttaaacaaagcagtagatatttacaattttaaaagtcagataaaaatagaagttttatgatagatgataatctctactctctggctcatctaatttgactgatgcttcttttgtcaactttctcccatctgccttccaccttccatggatttgttgaaatttcttaatcattaaggactcttgactctactattctcttccctgtttgggggagttataatgttttactcatttattatcaacagtgtttctctcagggagtgtgtggaaggaagagagagatatatgttgtcttccttgacctggatgttcctcatcccaaatttagttcagaaagtggtggttttcctttatttaagtaaatacacacacacacacacacacacacacacacacacacacacacacacacacacacacagttactctatgtttatgccagggaaatcgtggtgtctctgcctttttggagcttagagtctagagtggggatctagataaacatttgcctacagtgctgtgagagaggtcttagagggtgtcactaggattgttttctttggttaagtcaactggtttcagaactggaaatagaataagaacgcctaagtttattactgtgagtctcaaaattcctttggcttcctcattgcctaaattttcctcctcccattataacacatctaccattgtggcccagctttcttcatagctgttccttcagaacaatggaggcttgcttctggggtttgacttttctcttgcctgagctcccatcatgttctagcctcccagagctggctaatagccggaccgctttccttttatgtttctctctcttgtttcccagagcttataaagtttttggggcccattttatacttaaagtgtgtaatttattgttctttctggctcttgttctgcttcacctctttaggccatttggccttgaactcttcactgtcataatttttaacactgacctaatcagttgggagaatttcagatccaagacttgtgttaagaatttgaatacagccaggagattcagggagcaggtgaggctaagtcgctacccggtcccctgaccagcactttctttgtggtgattgagtaataggtcagttgaggatttttacttcccctctcatgggctgtttactaagaccaccaattctgcaattgttgagaaatgatgggatccctctggtggtgctcatttcttgggtgatgccacttccacagcagtatttttttcctaaaagtgttctttcctgttaacctcactgtagcagaacaaaccttatcagtgaagcagtcactagaaatatgcaaaatattaagtaggtcctagttgtcagagcttaaataatgataattgtttaaaagatgacttcacccacctccaagtttatactgttaacatcagctggaaattttcagtctaagaaacatctcaggtgattaaaagtaacccttaggtcacagtgaaagactctggcatggaacatttgttataacctgaggattatctccacatagatcttgagagataatgtcttgtcctcaatggtaaggcggcatgggatagttggaatagcaaggctgtagaattggattgacttaggcttaaaacctcctgtctcagttataagctgtgtgaccttggcaagtttaggaacccctctgaacctctatttactgtaatgtgcaaataagaaaatctgtctcttagagttgttgtaagaataaagtgaaatacatggcatatgaaaggcgataagtggatatttgtaaaccaacttcataacctgactagctataaaagaaaatatttagctaagatacttccggctgtaataattcttgattctctgattttatttgtataaaattaataaaatatgtattttaaagataactatataactacagagttcttggttgtcatgaattactgcttgctaaatcccctttgctggacatgtcaatttagagaaccaatggagaaggctttataccagatagtgcttgtagttctctgatctaagtccgtttcattatttcagtctttccagactctcctggggcttatgaagctgagtcaccatccccacctcctcctccgtctccacctcttgaaccagtgccaaagactgagcctgaacctccttctgtcaaggtaaaattatactgggattcttgcatgtccatgcatcctttgtgtcttaaggacctacaaccactatgctaaattagttcccttgctgtatacttcacaaatgccagtagatggctcttgtctcattctgctgtcctacaggttgtacagaatgggcgttccctccattcttacctgaagggagattttgctagtgggtatagtctcaggaacgttgcagaggtggaacctgggagctgttctgttttcatgaccttcagcatctctgctgtgctgtacagctcctgttagaatggtgtaaaaagagatcccccctgcatcagagcaacacgtgaaagacagaggggaacaaacaacttaacacacgtttgttgctcttcagaagcaattctggaaaagggctggatgggaaaactgtcaaccaaaggggaaatatagctttgaacgctcttcagctgcatcttatctacacctattagtgtagataatgaagagttgaaaaaatagtcgctgacaatttttttttcctttgtggctgttagtttttcttaattcattgtgttaagaccatcatttaaatcttacgctgatttcctcattagctgaagagaaaatgggacgaaagagaccagtggagataaaaggaagttgatactagtaatacctattttgagactaaattagatagctataatgttgaagtgtcaaggctggccaggcgtgttggctcacacctgtaatcccagcactttggaaggctgaggtgggcagaatgcctgagtccaggagtttgagacctgggcaacacagggagactttgtctctactttaaaaatatctgggcatggtggcacatgccttttagtttcagctacttgggaggctgaggtaggatgatcatttgagcccaggagttggactgttgcagtgagttatgattgcacttctgcattccagcctgggcaacagagccagaacttgtctctaaaaaacaaacaaacaaaaaaagaagacaagaaatgtgaaggctgacatagcaagtatctacagcaagggcatatgccacagaaatccctggtgtggtttaggggccatccctgtgtactcccataatatctgtctcagccctcactacactgtattgcagtggtctgctttccttctctctctcctccactaaggtccttatcctatatgtctttttaaccatgctgcctgcactacccaacaatagtttattgactgaatgaacagaacacagttctttcttcagcatgctactttccttcttatgaacaatgaagtatcaagcctgtgtatatagtgggcgtaacttgtctgtgtgatggggttggttctctaaaactaatgtagagtttctctttcaactttttatcataatggagtattggagagtgattagtatagatttaaaagcttttgttatttttctgtataacataattgatccagcttaacattgtatcctctgaccttttagagctcaagtggagaaaacaaaagaaaacgaaaacgcgtactaaaatctaaaacttacctggatggggaaggctgcataggtaagacaaatatttggctccaaatccagagatagaatctcttattaccacagaggcaccataatcccttttagaacaggtacatctcaaactttaatttacatgtgaatcatgcccaagtggtactgatgctgtttgtctatggcatacactttgtgtagcagagtgtaagtcagaacacctaggttcttgtttaggtcatagactataaaaataagcactgagatcttggctaaaagttatgtcgtccctggtgaagagtttcttatctatggaatatctattttgcctaaatgtgcagttatgaagattcaggtggcataaatatatccaaaaacaagatggaaaccacagtatgggcttaagatgttatcatagacattgagaagcttttttttttctagaatatttgtttttataaatttgaacagtggaaaagaagctacagatgattagactgtaatcaagagtcatctttggtatttggttccatttgttcttcagaagggtatgactcatcgagattgcttcctttatgtttcctatttgtaagccatgttaggtaaaagcatgtgcttgttatgaaggcctagggaggaattagagttcaggctttgagtcattggctagttcttcagccatgttttagcttcttctaccctttccataatcacactagacttctgtggagcttttaagatttagcacttgaggtttgatgggatgctcagatcctggtactgtatttttgtgtttgaaaagagttgtgggtttaggctcttacctttgttagttggatagcccatggttgtcattttgccttttgtggcacctgctacagcttggatcttcagagaagattattttccctgttactgatttttttttttcctagttcagacttgttttgaaaagattggctctgaagaatcaacctttccaggttcttaaaactagtgaagacattttgtcatctgtgctccctgtcccactattccccacctcccagtcctctgaaaaggcctctgccattttaattgtaacatgtgattggggagtaaaattctttacgtgtggaaattctgtcttttcagtgccaaatttcttgtgaacctgtgaattctggactttgaatgggtttttttttttctttttcttccttttttttttttttttggctttcagtcttttaatagttgccattttcaagcctcttggtttggccatgggtgataatatatgtgtttactgttgaatttcttaattcaacagtgcattttttaaatttaagaggacaaaaacattggtgccagttttttcctcctctttctgccccaaaagaaaaaagtcaaacgtctttgtgagagtgagagttcattgggaatttgtgggtaattatttattgctttgtttaaaatatagtactcgagttttggccaggtgtgtgatgtggacttttttgcactcctgtctccagacaggactgttaagagccttggatgcagcagtgaaaactgtgctcacattgcacttttttttttttttttaaaggtttttggtccaagctcaacctaatgaatcttggctttggttaccaacaaaggagttctgctttcctctctctgctcagactgttccaaatgtaccagcatagggggcttgccctgtcctgtgctggatcagatttgttctatgggtttagaaagctcatctttctctctttgtgactttgcagcagaaattgggtagttgggcccctgagataagtttggagtagacttctggacaagggaatgggtttctaagagcaaagcagttaagtggaaaagaaatctgatgttacccacgaaaaccaggtttgtttgcctttttttaatggcaacccagaaaagtggcatgttgttcagctaaaataaaggccctatatttttaatggagacctccttttttctggggtttgcggtagctacagctttgaatatagaaatattccttttagttcttacagtatactgaatatgctgctaaagaaattttgttggtgctgccctgactgttttttaactcccctgagcaatgtctcacacaaaattggcaatgagacagccattgatttcattaataagtaatgaaataatgagctaattgatgctgaagtataatgtagacatgctgccatttgagtacagaatatagcttatgaaggagcaaagtcttataccaccaactagtagaaagtaatttcctttctgtatctgtagatggctcttcagacttttctaatttaagatattgaataaataacagctcgtaattttgtcccattaattcagttacataatgcttttgaagatgcatgtgagatggaggtggtgttctggggtctaattgctgaacgaataggtatgccatgggaattctctaattatcttagagcaacatttctcaaactttgccggctatgtgcattacttgaagatcttgctaaaattgaaattctgcatcagtaggccaggagtgggaactgagagtgcattcctaataagctcatgggagattctgttgcctctggtgtgcggagcacaatttgagtagtaaggcctttcagaatacttaatatatatctaaaatttatcagtattttttagcctctaagtgaacatcaaagtgaattctgggctcttacaaaattaaagacaaactctgggaactctctgggaagggattgttgattatgcagccttaatgggattagctggataagagggacggaatgctccagtggcaattgcacttcaacatttaaaacagggaaggagagaacattaattcccagagtgtggtccccagaccagcagcatcagcattatctgggagcatgttagagaagcaaattctcaggtcccaccccagatctgctgagtctgaaacttgagaaacagaatctggcaatctatgttttaacaagccctccaggtggttctgatgcacagtaaagtttgagatgatatcttaagtagcagagtaggtattgggacacacatacatttgattccaaagcttatgcctctagaacaatttgatatattttattagaaagaattatcaataaaagctcaagactgtcattgttctttaatggaaaaaaaaaccttttactttaatcatttgagcatttattatgcatattaggttacgcttttcagctaagaacaagctcttttccttcaatgtttctctatcgcttgctgcaaccaggaaggctgagaaagaatttagatagcattggttatacagctgccacagctctctaaaattacagaaaggtggcatgctgtttcttgtggttggtatatgtgttgcagtagtgtagatcctcctcggttatgtgacgtcatggctggaagccactatctgtgcctgtgtcctttggggcttgctcataatgactgcttactgttacagttcttttccaagtttcccttgggaagggttcagtgagttttaatagcaggggaaaagcaatttatgccttcggctgatagggagtaagaaaactggtaactttgtttctcaatttatcactgtcattcctttaacacgtgtgtcatccgatagcatttgcttgagatagttaaccttcatgatacagactactactaaattttgggttaatttgcagccattaagaactaagaaccgaacagttgagtaactaatcttcaattctctgtacctaggatgtgcagagagtgggtggcatcaggttagagctagacaggagggtccatggtgaccttggttaaacagaatggaggcaggcaaataggccagcagtttaagaccagtaacgggaataggcaggcattgtaggtcagagaggtgatacttaagaagccagtcaaagcatggagttagaagtaagtgtttaagatatagacaattcggatatagagttcaggaagttagccagcataggccaggacccaaataaaggatttaggcaattcactgataaagggccatttaaaggcatgggatatagctgtgagggagaaaagtgaacgttaattctaagcatcaaatagagactgtgtgagctcaggatcccacatagttcctaccttaggctagatctgatctcccagtgggagaaagattgagtcctaagtaagcatatttgccttgatcagagtctgaaatgattggggttagcaagacatcccattttcttcatagagtaaatgattcagcccacccatgttccatttttttctcatcctaccagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaaggaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttaccaagggtgtcaagactaaagtcaagtgtatgtagcatgaattcggtccatgttggcggtcacatacgcgctctacaaaatggtggctttctttctgatgtcataagtgatgtaatcagctagcagcttcctgaaatgttatcagttatacgacccaggtggtatattcttcagtcattctggctgtacatgtagtaaaaaggggaagatagttgtcctatttcatgaaaggtttaaagagagtagatattttcctactgaaggaattatagatgcctatatttactgttcatttattgtgtatctactatgtgtcaagcccatgacctggggactagaggatataatagaaaccatagaatttggcacttgatcctcacaatttagtggaagggaaagccagtaaaatgaaatgacagtgccatatgtgagtgcaatgtacagggtcctccaagagttcccaggaggatgggtatcaaggcagtcttcctggagcaagcagttctttgaatgatgagcaggatttcacccagcaaagaggaatggaaatgactttccaggcagaggagcatggcttttgggagaggtgggctgtagaacttgagaatagggaggaaaatgtattcagaaatgaagttggggccttgctaagcagtttggatttgatttgtagataatgggagccaactgaagaaatttaagaagagtaacagaagttggttctcagttaagagtgacagccagtatttactttgattttgtatccatgatagtatttctacccttgcatatgcacattgtatcttaaaattctagcgggattaaagaaaaccatcttggttaaaacaaggccgcttaattctggcagtcagcatagacaattgcagtgtttcccttgtcttcccccgtcaacatagatttctgtagcagaatcaattttttaaagtgatttcaaaagctggtatttcttctttgacactctcagtgatgagcctccactcacctccctggaaaaaactgggaattcaggggcagagggggctggtaaacgagtgaaacagttctctattccttttctatctttgtttctttaagaagacattagttattatacaggagagggctgaagagaagggccatataaggaaactaaatagtttctccaggacatgagtagaatgagtgcctaataatgtatttgccagaaacgtactctgtgtcaagactcgttttggtaaacttgtctcctttcattggttccaggatctcagtatgctgtaatgcagcttttaccaccatgaaacattttggggctgcctcgttttgttgtgagaaggcagtattgctttctgagttattgccctggcagctctgtaaattagcccatgctgtcaccatgccctctctgaagggcacattgtacccaaatgactgcatttaggattgactcttaccactccctgctgcatgacacttttctccacttgtatctgtgtccagttttttgtgttcttaggtgcggaccacccacagattaccacccaggctctttagccagagaaacttggtaaggcttctgatccaatatttttccattggatcagaatccaccttaactctacaattccccttctacttcaaacccttaatgttttctgaacacccattccccttaactgttctcattttctctttccagactccatgtttcttgaggtttcaccttggctccctgtacctactttcttaatattcagagttcttcatggctggttcttcagcttcattcttttggtgttttaggctttctcaaggctcttcatggcatgtcttttaccggactgctcttgaagaatggaaaaactactttgtttagtgtctgtttgggatcagtcagatccaaagcataaagcagttattggaagctagttatgtttagtcctggataaaatactttggggattgtaagagcccgtaagttaccattttggagtgacaagacaaacatactaaatagcatttagcatttgacacaatgcttagatgagtgatagacatgggacttaataatttaggaatgaattaggataatcattatgggcaaaatattatattcctatgcaaagaacaataaaagatttaaagaaagaaacaggctgaggtaggctaaccattttattgggtgttattcagctatttgaacttcacttgccacttgtacattcacggtgtaagtaaaccatgatttagtgaatctttaattaatggagttatttctgttgtgctttaagcatgagagtattgacgagaaagcaagcagttatcaggaattacttcaaaaggcagtttatacaatataaagtctgtataggctccactcagttttgtacacactcaacaattttgacctactagggaggcaggatgccgggatggaaacaacacaggctttagagacagagggcactggatgcaaaccctgtctgaggcactgaccttaagcaagatatgcatcctctctgaacttgtttcctcatctttaaaaatgagctacccacctaccttaaagcgttgctttagggcgttaatgaaataatgcatgggcagtccccagtattttgacacctattaaactaatacaaagcagagtaactcacatttacctcttttaatcctcatagcagccctgtgagataggtacttttattcccattttgcacatgagaaaactgcggcaaaggggttaagtaacctgcccaaggtcagagccacgatataaatcatgacaatttggcttcattgccctcagtcttaaccactgtgctatattgcctcttggctatgtattagttcatacttccataccgcccagtgatgattgatgttttttttttttttttaagacagagtctcgctctgtcacccaggctggagtgcagaggcacaatctcggctcactgcaacctgtgctttctaggttcaagcgattctctgcaacctccgcttcccaggttcaagcgattctcctgcctcagcctcccgagtagctgggactacaggcgcatgccaccacacctggctaatttttgtatttttagtagagacggggtttcaccacgttggccaggctggtctcaaactcctgacctcaggtgatctgcctgcctcggcctcccaaagagctgggattacaggtgtgagccaccgcgcccggcctgattttcatttttataagtgaaagtgcagctggttgttgagatccaagattgtcagatttgaaggcaatcttaatgcttattcaaatcaacctcttatctgatgtctgcatcttctctgcagcatccctgccaagtggtctggaatctataaacaaagattcaattatgttcagtataccatacttaactaaattacaaagttagataagtaggctaataaatgttaagaatttaaagagaggctggactaaaattaagttttctgattaattttagatcaccaggaaacttccaaatagagcatactgctgtaagcagtccatttaattgctttcagtttaagtcgagaacattgttttccttgaaaaagcttgtctgattcttggccttgcctctgacttaacatttataagaaaatcaagaggacatttggcatttgtgccctgtttaagctatgctacaggttcataggttgaaaagtggtcctggggtgcttgcaagtgggttaggccagggtggtgttctccactttgaatgtcagagccttgttttcctaggatacttggtttcaagcttataaggtatgtgaagattacataaacatagcataatgacggtacagtgcagtggtccccaacctttttggcaccagggaccggtttcatggaagacaatttttccatggccagataggggagatggtttcggggtgaaactgttccacctcagatcatcaggcattagttagattcgcataaggagtacacaacctagatccttgcatgtgcagttgacaatagggtttgtgctcctgtgagcatctaatgctgcagttgatctgacaggaggcggagctcaggcagtaatgctctttgcccgcctgctgctcacctcctgctgtgcagctaggtttctagcaggccacagaccagaaccagtccgcagcccgggggttggggacccctggtatagtactttttaaagttctatcctggaatgggatttacggaaggcagaaccattttcctgcaaaccataaaacctgataggagtgttttcccttgtccctcttagttgtgttctatatgtatttatatgctttactttatcttacttcatcctcatgataacctgcaaggtctctcccacattttgcagaaaagaagcccagggagttgagctagtatggccagcatctcacagtgagaaagtgtaccagggctagaacctaggtcttgagactttgtgtcttcagatgctgcatcatgtgactttcccacagtatagcaacccctaagaagaatatattggtgcacttacaaatgtggcttgagtcattaaatgcttgcttatttgcccaacaactatggtggctactgtggattccagaaaagtacatgacaagttctctgccttcctggaactgaccatctgttgggaaggcaaaaaaacatgtacatatttgtacatttcacagatttttgactaaaagtttactgtgtacccagcactggtgcattaaatactggggatacaaagatgaatttcttgcccttgatacatttactatctagtgaggagagagacagacaaatatgctataattatattataataatatttataagagtgcttaccacgggctcaaatttttgctagatatttaatacactttctctaatcctcacaacactttatttacacatgaagacaggaaggctcggagagtttaaatgatttgcccaataagtggcaaaggtgagacatgtctctgtttaataatttataatgaaaagttagagaaactagtatatttgaacgcttgtgattagcaaacctgcatggaagtcaacttccctttgggtggatcaaaaggagcaaaatgaattatacctttacaattgtcattctcaggtaggtgtgatcttgccagtaagtctgagtctttttggctacgatctgcagcttgtatctccacttaaggaaaccacaccagtggactatatgttaggctagagatgaaggctttctcccctctggttggtgttctagctggcctggggagagggccacatttgaactctagtctttctgacttgaagtctatattctgactactgtaccatgtccttcctcctcctgtgtaaaggaggtgtgtgtccataggtcagtgtggtcccaagaaagggttgcctgtgactgcctgagggattaagggaagattcacagaggaggaagtgcttaaacaggtcttgagaaaaataggagtttgccagatggaaagcgagaagggcataccaggcagaaggaacaggacatacaaaggcatggacacacaagaaagcacagactgtttagagagttgtaagtggtttagtgagaggcagaatggttggctatgaggccatataagtaggcagaggccagctcacagaggtctttgctaagtagtttagaccttgcactataggcaataggaagccactgaattttaacatgtcagattcgtacattagaaagatcagctttagtagcctaaaggtataaagtagatcataagtaacagccaaattgaacctgtatcttgagttagaacaagcagaggaaaataatttgaagttagatctagttttgttttaggcagatgactcctttgatccccttggaaactcaggagaggagagtattaggagtgacttcaaatgtggaatgattagccttttgctaggtcgtctcatgcttggaaattctctggctcttgcctgagccatggtcctagttaaaccatggagatgggattggttccacggtttcaccaaggattcatgtaggccattctctgacgcacatacacacactgattcagacctggaactgactgcatctccctggaattctttgggtcaaaaatgacccatagtcctagactgatcaactaaattcatcccaaatcttactaacacctattctatgccagatgctttcatatactttatatcatttgatccgtaacaactttgtgaggtgtaggtatcagcccaatttgatgaattaggaaattcaatggtagaaaggctgtccagctagtacatggtagagctgggatttgagaggcagacagagtatcctattgtcatccattcttagtgtaagttttttccagtggcgtggagtgttgtaaacattcttgcatatcataagtgacattcatattagacattgaatgaccattatacttagaaatgtaccaatgatttaattcttttctagcagtaagttttgctgtgaactccaaagctcacccctaaaatacagcaacagctatcctgaagctcctgcatgaaaccccccactctatcttagaattgtgcatagttcataatacatgttatatgtcttcccagcctgtacactttagaagcagcaaagcagcaagagacagttgctttttggccacgtgcggtggttcatgcctgtaatcccagcactttgggagaccgaggcaggtagatcacttgaggccaggagttcgagaccagcctggccaacatggtgaaaccccatctttatttatttgagagagagagagagatacttacattttggaaagtactctggctgcagttggagagcagactggctcactttttgatgttgtagaaagtccttggactttagagtcaggcaaactggagttcatgcccttttactatcagcgtgactcccagaaagtcaccaaatttctctgagcctcagtctgctcatctgtaagatgaagcttgtatctacctcaaggttattgtgaggattagagataacaaatataaagtgcccagtttatagtggttgggtttttattgtttcagagtaatgctttggactttaatcttacctgtgtgagaaaaatgagttgtcgtactttgctaatttttttgccaactaacctttattggagtgcctactttgtgctgtagacagcacatcagactgtcaaaactgaggttctaacaaagtgaggagggagggctaatggacccagtgtttccttgcagttctgctcacctgtcaaattcctgactcccctttgtcccaccagcacccctacctttcaggtgggctgcgtgtcattctgtgtgctacacaacacacccttgtttcaaccatatttctacttgaagtcgtttagaggaaagccaaaggtctgagtatgcattctatttcctcaagtacagacatcagagaatgctgtttattaatgaaaaaataaacagatctttggcagcaaagaagcctctcccaatgatgtatggggtgcttgggctatagtcacgcctgcagtttgagcccatctgttttctctgttcacctcctgagcactgtccccttgtggtttgcatcattccttaagaccagccaactccaaccctcctcagtccactcattcaatagctgtcttatttaaacacacacactctctctctttgggtgccagatgtgaagtttcaaggcagcagaggctgggctggctagtgccatgacacctgctttagtaggcaagccagtcagctgccgcttctgatgatgttggctcttcttcatggacagcatgagggtttcaccccaccaagtgcacacacaggcagctgagggagcctcataaattatggttttgtttgtttacttcgggcagacagtgtggtgtagtggaaagagccctgcacttggacgcagaaagcacgggtttgagtgcttggtggttatgtgctttctgtctacagagcacctcttcatggcacttatcactatctctgctaattgtgtatctgtttatctgcttattggctatctcctccaccacaatataagttctaggaagtcacggactgtctatcattctatctccagtacctaggacagtgcctagaacatagtaggctcttagaaaatatttattgaatgaattaatgaattataaaactgcctcttctactcactggccatgtgatcctgggaaagtcattctcttctctgggcttcagttttatcaacttggttgaaagcattagttctctatccctgatgctgtaagagtttaagaattcattcatttaacaaattaccttgtgtctccatagagggtactgccaagccctaaaactacacagtcatgaacaaggcagaaacagaacgtgctctcaaggagttttgaaagagagagacaaccaaataaataattgcatgaacaattatgtaatgaccattgtgataagccttataaaaggatctgtacagggcactaggagaaaaaccacacaggagggccatgttgggggttgtcagagatttcttggtgaaagtgacatttaagtcagactttacagataagtagttgaccaggcaaagatggtacagtatttcagggagagggaagagcatttgtgaaagtccagggtgggcatgtggctgtagcctggtgaccaacagggaggtcatgccaagatcaggctagagagggaggctgggccagatggttcagaaccttgtcggctatggtaaggattctgtcatatctaaagacaaagggaagtcattgaaaacaattcctgtcattacaaaggctttactagtacatacagaggggaaagctggactcagccttacatggctgtcagaggtagatagagcagatagtacctccattttgtagctgaggaaataggccccagggatgataggtaacttaccaagaccactaggcaagtcagtggtagaacttgatctctaaaattttagtctacttttctcaatactatatcacattacaaagttgagagggttttctttcccttcacatactctagatggccaaattttagacctaaatgccttgtaataacagctctcatctgcaaattgaatgtctcgaaagcaacttttaagcaagtctgttagcaacaaatccctccagagcattatgcttgcattttgggtaactacaaccatatctttgatgcccattttagattattgttaggatagattgttaggaatagaattactgtgtcaaaggatatacattttaagaaacttttcatacatattgccaacttgtcttcccaaaggttgcgtatcatcatcagtatatgacagtgactttctcagtgcttcaagtaatagagaccaactctaatttaagcaaaactgaatagagcttactttctaatcatacatattttgttcacttagagatgggaaactcaaccaggctttggcaatttgaattgaggaagaagatgaagctatagagatagtgcccaaaggaggcagaaaactcccgaaggcattgttcactgtgaagaggcacacaacatagacattaaagataggaaagtgaaggcaaactctattgtattctactaaaggaagaatcctcagcattgtgacattctgctaaaagtaactccaacttggaaaagcccttcctctggcttgctacaaaactaattggagatcctaacttggagtttgttgccatgcttgcccttgccccacaagaggttgtcatggacccagctttggcagcacaatatatcatgatttacaggttgttcaaatgttctcccggatgagaatgatgatctgtaagaaaattaatctggagcccagcatcagaagtatagttttataagcatctgtgctgtgctgtcagtggtgtagcatgtttgccattttattgtgtagctaagcagaacatgtgctttatctttgggatgctgaaggagatgaatggacttcaaaaataccttcaatttttggacctgcatatttagctgtttttgttgtttccttctggagtttcatatatattaggttggtacaaaagtaatggcagtttttgccaaagtattgcaaaaaccacagtaacttttgcaccaacctaatacttaacatcataatattcagtggtgaggatcttattttactgccattcccattccttttcatttagaaacagaataaagttgtatttcaaatacctaagagagatacacacacacatagtgtggtccataacataagtagaaataaaatacttgacaaaactagcacaaaggatgaggagggagtatggaagtatagtatactcttcttcttatgttatacttgaggtggtatattatttttaaattaataactttttaaacaacttaactgttttaagttaaatatgcgtattgtaaacctgagagcaaccactgaaaaccacaatgtataactccaaagtatagttaataagccaataatgcagatgaaatggaatactaaaattaccaatgaatgttagaaaagaaggaaaaaaaggacaaagaatagatgggacaaatagaaagcaataaaaagacattagacttaaccatatcaacattaaatgtaaatggaatgaacacttcaattaaaaggcagaaattaccaggctagattttttttttacaaatggatacaaatatgctgtgtgctagtctgttcttgcgttgctgtaaagaaatacctaagactgggtaatttacaaggaaagaggtttaattgtctcatggttctgcaggctgtacaagcatggtgccagcatcagcttagcttctggggaggcctcagggagcttttactcatggcagaaggtaaagcaggaacaggcatgtcacatggccagagcaggagcaagagaaagaaggggaggggagatgccacacacttttgctcaaccagatctcatgaggacttactattgggaggacaacaccaaaccatgagtgatccccccagatgactcaaacacctcccctcagccctgacttccaagatgagggatcacatttcaacatgaggctttgaggggacaacatccaaactatatcatgctgtttacaggaaagcatgttaaacataaagatgcagataggttaaaagtagtaggacagaaaaagaccatgcgtacacaaatcataagaaacctggagtggctatattaatatcacatgaagtagacttcagaacaaggagtattaccagatgtaaagagacataataagagagttaatcaagaagatataatactcgtaaacgtgcacacaataacattaaataaaacagaactaaaaacaagtagataaatctgtaatttaggggaatatagaatgatgagcaggacttctggaatgacagagtaagaagctcagaaaatcctctttaaaaagaaattgtcaaaaacaaaattgattaaaggcttacaacaaattgagaagcatttattcgtgaaaaactactgaccctcaagtaaaaatagtgggagtctgtggtgttttaacctggggctgcttccaacccaccttctctcctctgctccccaccagcttggtcaccatagtaattgtgctacaaggaaagacaaatcacgaaaacctgcagctttgctgtgggaaggagctcacttgatttgaagcagaatttgaaaaactgcatgcccggggtattgaaagaaaaaatagcagtctcagtgacgaactaacaaaaagcaagacaacaattcagctagcctgaagttgaggtcctggttggagcaagcaagggaccagggagataatgggaatgagagccatagtgagcttcgataagctgccacatatccctagcaaagcacatgtgcaggagagaccaaagagtgccttggctatccacatacacctggtagaacttgaggccatgcacacaggtagaggaaatgtgagagtgcccaacagaaaggaaatgccgaggcagacttgtgaactgcctgaatttttatgcatttcccaacccacatgtagatgtgtgacattgtggaaagtagaagtcttactggctcaaggtatttgagcacaacctctgatcaatcattagctgaccactaagcaacactgacatgggcgtaagcccttgcagcaaggcttaaaaataaagacaagaatttaagaacggaaatgaaacaaacgagagagatcaatggtcccgcaccacagactctatagatttagtctaggcaagttactaacaaaagcaaaaacaacccctagaggggaaatgtcagatttcataattgctagactatattatctaaaatatccagttttcaaccaatactatgaaatattcagagaaacaggaacatgtaacacataatggggggaaataaaatgatatgcaagacttgaaaaactttatcaatcaacttgacctaattgatatttacggaacacaacactcagtaactgcagaatgcctgttcttttcaagcatgcatagaagacaaaccatggggatttttacaaaattcaacacctatatttgaccaaaaaaaaaaaaaagaacacttttcaaaaagtaggaatagaagaaaacatcctcaacctgctaaatggaatctacaaaacactaaataccatatatcatactttgtgatgaaatattgaaacgttctaagtttgggaacaaggcagggatgtctggtatctgttcatgcaatattattatgtgactggaggtttcagcaaatgcaataagatgagaaaagtaaaagtcatacagattgaaaggaaggcataaaactgtattttcaaagaacaagcaagtaatctacaaaacaaaaatctagggctaatatgtgaatttagtaacgtgacaggatacgaggccaatatacaagattcaatcttttgtatatcagcaattagtaattgtaaaataaaaataacatttaaaatgccatttataatagtgtcaagaacataaaatatttagggataaatttaatgaaatatgttcaacatctctacactaaaaactaaaacagtgatgacaaaaactaggttatttgaagtttttcttcttttttaatgtaggtgcttatagctataaaattccctcttagtactgcttttgctgtatcccataggttttatatgttgtgtttccattatcatttgtttcaagaaattttttggccgggctcagtggctcatgcctgtaatcccgccactttgggaggctgaggcaggtggatcacgagatcagaagtttgagaccagcctgaccaaaatggtgaaagcccgtctctactaaaaatgcaaaaattagccaggcatggtggcacgcacctgtaatcccagctactcaggaggctgagtcaggagaatcgcttgaacccgggaggcggaggttgcagtgagccaagatcacaccattgcactccagcctggacgacagaatgagactccgtctcaaaaaaaaaaattcttcatttcttcattgacccactggtcattcaggagcatgtagtttaatttccatgtgtttgtatagtttccaaaattcctcttgttaatgatttctagttttattccattgtggtcaaagaagacatttgataatatttcagggttttttttttttttttaaggttataagatttgttttgtgacccaacatatggtctatccttgaaaatgatccatgtgctgaggagaagaatatgtattctggagccattggatgaaatgttctctaaataactactaggtcaatttataatgtagttcaggttaagtctgatgtttctttgttgattttctgtgtaggaaatctggccagtgctgaaagtagattgggggcatatatatttacaattgttatatcctcttgatggattgatgcctttaccattatataatgaccttccttgtctcttacaatttttgtcttgcagtctattttgtctggtataagtatagctactcctcttttttaaatttccattcgcatggaatattttttccatccctttattttcagtctttgtgcgtctttatagatgaaatatgtttcttataggcaatagattattgtgtcttttttttttaatccattcagccactctgtgtcttttgattggagaacttagtctgtttacattcaatgttattattgataagtaaggatttacttctgccattttgttgttttctggttttcttttcctttccttcctgtcttccttttagtgaaggtaatcttctctggtgttatgacttaatttcttgctttttattttttgtatatctgttgtatgttttttgatttgaggttattatgaggcttgcaaatactatcttatgactcattattttaaactggtgacaacttaacactgattgcataaacaaacaaaaagaaaactaataactacactttttgtctccccacttgttaactttttgtttttatttataccttattgtactgtatgtcttgaaaagttgttgtagttattatttttgattggttcatcttttagtctttctgcttaagagtagattatacaccacagttacagtgttataatagtctgtttttctgtgtacttactattaccagtgagttttgtatcttcagatgattttttattgctcattaacatccttttctttcagattgaagaacttcctttagcatttcttgtaagacaggtctggtgttgatgaaatccttcagctttgaaagtctttatttctccttcatgtttgaaggatgttttcaccagatatactattctagggtaaaagtttttttcccttgggactttaaatatgtcatgccaccctctcctggcttgtaaggtttattagatgcctcaaggtagtcaagttaaatctatttggtgttctatcatcttgtacttgggtatttttattagttcattttcatgctgctgataaagacatacctgaaactgggaacaaaaagaggtttaattggacttagagttccacatggctgagaaggcctcagaatcatggcaggaggtgaaaggcacttcttacatggcagcagcaagagaaaaatgaggaagcaaaagcagaaacccctgataaacacatcagatcttgtgagacttattatcacaaaaatagcacaggaaagactggcccccatgattcaattacctcccccggggtccctcccacaatatgtgggaattctgggagataaaattcaagttgagatttgggtggggacacagccaaacagtatcattctgctcctggcccctccaaatctcatgttctcacatttcagaaccaatcatgccttcccaacagtcccccaaagtcttaactcatctcagcattcacctaaaagttcacagtccaaagtctcatctgagacaagccaagtcccttccacctatgagcctataaaatcaaaagcaagctagttacttcctagatacagtggggatacaggtattgggtaaatacagccattccaaatgggagaaattcacaaaaacaaaggggttacagggttcttgcaagtccgaaatccagcagggcagtcaaattttaaagctacaaaatgatctcctttgactccaggtctcacatccagctcaccctgatgcaaaaggtgggttcccatggtcttgggcagctccacccctgtggctttgcagggtacagcctctctcctggctgctttcatgggctggcattgagtgtctgtggcttttccaggtgcacggtgcaagctgccagtggatctaccattctggggtctagaggatggtagtcctcttctcacagctccactaggcagtgccccagtagggatcctatgtgggggctccaacctcacacttcccttctgtactgccctagcagaggttttccatgagggccccactcctgcagcaaacttttgtctgggcatccaggcatttccatacatcttctgaaatctaggcagaggttcccaaaccccagttcttgactcctgtgcacccgcaggctcaacaccacatggaagctgccaaggcttggggcgtccaccctctgaagccacagcctgagctgtacattggcccctttcagccacagctagagcagctgggacacagggcaccaagtcaataggctgcacacagcacggggaccctgggcctgacctatgaaaccactttttcctcctgggcctctgggcctgtgatgggaggggctgccgtaaaggtctctgacatgacctagagacattttccccatggtcttggggattaatgctagactccttactacttttgcaaatttctgcagccagcttgaatttctccccagtagatgagttttccttttctatcacattgtcaggctgcaaattttccaaagttttatgctgtttcgcttttaaaactgaatgcttttaacagcacccaagtcccctcttgaatgctttgctgcttagaaatttcttctgccagataccctaaataatctctctcaagttcaaagctccacagatctctagggcacaggcaaaatgccaccagtctctttgccaaaacataacaagagtcacctttgctccagttcccaacaagttccttatctccatctgagactacctcagcctgaaccttattgttcatatcactatcagcattttcatcaaagccattcaacaagtcttgggaagttccaaacttttccacatttttctgtcttcttctgagccctccaaactgttctaacctctgccgttaccgagttccaaactcacttccacagttttgggtatcttttcagcaatgccccactctactggtaccaatttactatattagtccattttcacactgctgacaaagacatacccgagactgggaagaaaaagaggtttaattggacttacagttccacatggttggggaggcctcagaatcatggtaggaggcaaaaggcacttcttacatggcagcagcaagagaaaaatgaggaggaagcaaaaccagaaacccctgataaacccatcagatctcgtgagacttactcactatcatgagaatagcacaggaaagactggcccccatgattaaattatctcctcctgggtccctctcacaacaggtgggaattctgggagatacaattcaagttgagatttgggtggggatatagccaaaccgtatcagtattgatatctttctctaggttttggaagttctctgttattatccgtttgaataaactttctactattatactatctctttctctacctcctctttaaggtcaataactcttagatttgcccttttgagcctgttgtctagatcttgtaggcatgcctcattctttattattattttttcttttgtctcctgatatggtttggatttgtgtccctgcccaaatctcatgttgaattgtactccccagtgttggaggaggggcctggtaggagatgattgtatcatggtggtggatttccaccttgctgttgtcatgatagtgagtgagttctcatgagatctggttgtttaaaagtgggtagcacctccccctgtgcactcttcctccttctctggccaggtaaggtgtgccggcttcctcttcaccttccgccatgattgtaagtttcctgaggcctccccagccatgctttctgtacaggctgttgaactgagtcaatgaaacctttttctttataaattacatagtctcaggtagttctttatagcaatgtaaaaacaggctaatacatctcctctgactgtgtttttttcaagtagcctgtcttcaagctcactaattctttcttctgcttggtcaattctactattaagggattctgatgcattcttcagtatgccaattgcatttttcaactccagaatttctgcttgattcttttcaatatttcaatccctttgttaaatttatctgatagaattatgtattccttctctgtgttatcttgaatttctttgactttcctcaaaacagctttgaattttctgtctgaaaggttatatgtctctgtttctccaggattggtccctggcactttatttagttcatttgataatgtcatgttttcctggatgtcttgatgcttgtggatgtttgtcagtgtctaggcattgaagagttaagtattcattgtagtcatcacagtctggccttgtttgtacctgtctttgggaaggcttttcaggtattcgaagggacttcagtgttgaatcttgaatgttgtaatctgagctgtactgcattagggggaaccccaagcccagtaacactatgatttagactcgtagagtcttcggtggtcttagataagacctggaagaactctctggattaccaggtggagactcttgttctcttcccttactttctcccagtctttcactctctgtgctgagccgcctggagctggagtggggtgacacaaacacccctgtggccacccactaggactgggctgggttaggcctgaagccagcacagtgctgggtcttacccaagaccccgttagcctctacctagctttcacctatgttcactcaaggccctagagttccacaatcagcaggtagtgaagccagccaggtttgtgtccttttcttcagggcagcaagttctcttaggccccaggtgggtccagagatgctgtctgggagccagggactggagtaaaaaaccttataaatctaccttgtgctctattctactgtggttaagctgaactcatgctacgagacaaagtcctttctactcttcccttccctttccacaggccgaggagcctctcccaatggccaccaccaccacaggcccatggggagtactgccagtctcactgatgttcacttacagcccaagggctcttctgtcagcttatggtgaatgctgccaggcctgggactcgcccttcagagcagtgggctcctctctggcccagggcaggtccagaaataccttccaagagccaaggcctggaattgtggatcccaagagcccgtttggtactgtaccccactgtgggcaagctggttacttaagtgtaagacaaagtcccctttacttttccctcttcttttctcaagcgggagtctctcaccatggccatcacagctgggaatgtgctgggtctcacctgaagccagcatgtctcagagtctcaccaaggcccatggcgtactacctggttattgctgctcattattcagagcccaagggctctttaatcagcaggtgatgaatcctgcctgacctggccccttctcttcaagggaataggttttcttctggaccagggtgtgtctagaaatatctgggagctagggcctggaacgggggcctcaaaactcttcccactgccctatcctgtcgtgcctgagctggtatccaaaatgcaaatcaaaattctttttacccttccctctcctcaagcagaaggaagcagtcactttcattgctgagaactgtgctgcttggagttggaggaggagtggcacaagcactccattagccaacccagctggtgtctcactaggtcacatgccccccaggtccacaa
